US009987311B2

(12) United States Patent
Mulder et al.

(10) Patent No.: US 9,987,311 B2
(45) Date of Patent: Jun. 5, 2018

(54) COMPOSITIONS COMPRISING BACTERIAL STRAINS

(71) Applicant: 4D Pharma Research Limited, Aberdeen (GB)

(72) Inventors: Imke Elisabeth Mulder, Aberdeen (GB); Amy Beth Holt, Aberdeen (GB); Seanin Marie McCluskey, Aberdeen (GB); Grainne Clare Lennon, Aberdeen (GB); Suaad Ahmed, Aberdeen (GB)

(73) Assignee: 4D Pharma Research Limited, Aberdeen (GB)

( * ) Notice: Subject to any disclaimer, the term of this patent is extended or adjusted under 35 U.S.C. 154(b) by 0 days. days.

(21) Appl. No.: 15/359,988

(22) Filed: Nov. 23, 2016

(65) Prior Publication Data

US 2017/0143775 A1    May 25, 2017

(30) Foreign Application Priority Data

Nov. 23, 2015 (GB) .................................. 1520631.1

(51) Int. Cl.
| | | |
|---|---|---|
| *A61K 9/19* | (2006.01) | |
| *A23C 9/152* | (2006.01) | |
| *A61K 39/39* | (2006.01) | |
| *A61K 35/74* | (2015.01) | |
| *A23L 33/135* | (2016.01) | |
| *A61K 39/08* | (2006.01) | |
| *A61K 31/00* | (2006.01) | |
| *A61K 35/00* | (2006.01) | |
| *A61K 39/00* | (2006.01) | |

(52) U.S. Cl.
CPC .............. *A61K 35/74* (2013.01); *A23C 9/152* (2013.01); *A23L 33/135* (2016.08); *A61K 9/19* (2013.01); *A61K 31/00* (2013.01); *A61K 39/08* (2013.01); *A61K 39/39* (2013.01); *A23V 2002/00* (2013.01); *A61K 2035/11* (2013.01); *A61K 2039/542* (2013.01); *A61K 2039/55594* (2013.01); *A61K 2039/577* (2013.01); *A61K 2039/58* (2013.01)

(58) Field of Classification Search
None
See application file for complete search history.

(56) References Cited

U.S. PATENT DOCUMENTS

| | | | |
|---|---|---|---|
| 5,589,168 A | 12/1996 | Allen et al. | |
| 7,749,494 B2 | 7/2010 | Renaud et al. | |
| 7,998,474 B2 | 8/2011 | Kelly | |
| 8,460,648 B2 * | 6/2013 | Borody | A61K 35/741 424/184.1 |
| 9,011,834 B1 | 4/2015 | McKenzie et al. | |
| 9,314,489 B2 | 4/2016 | Kelly et al. | |
| 9,539,293 B2 | 1/2017 | Kelly et al. | |
| 9,662,381 B2 | 5/2017 | Honda et al. | |
| 9,796,762 B2 | 10/2017 | Kelly et al. | |
| 9,808,519 B2 | 11/2017 | Honda et al. | |
| 9,839,655 B2 | 12/2017 | Mulder et al. | |
| 2003/0147858 A1 | 8/2003 | Renaud et al. | |
| 2008/0069861 A1 | 3/2008 | Brown et al. | |
| 2010/0284973 A1 | 11/2010 | Schiffer-Mannioui et al. | |
| 2010/0303782 A1 | 12/2010 | Cobb et al. | |
| 2010/0311686 A1 | 12/2010 | Kasper et al. | |
| 2010/0316617 A1 | 12/2010 | Renaud et al. | |
| 2014/0037716 A1 | 2/2014 | Nowill et al. | |
| 2014/0147425 A1 | 5/2014 | Henn et al. | |
| 2014/0154218 A1 | 6/2014 | Kohno et al. | |
| 2014/0199281 A1 | 7/2014 | Henn et al. | |
| 2014/0335131 A1 | 11/2014 | Mazmanian et al. | |
| 2014/0341921 A1 | 11/2014 | Honda et al. | |
| 2015/0071957 A1 | 3/2015 | Kelly et al. | |
| 2015/0104418 A1 | 4/2015 | Flint et al. | |
| 2016/0067188 A1 | 3/2016 | Cade et al. | |
| 2016/0199424 A1* | 7/2016 | Berry | A61K 9/0031 424/93.3 |
| 2016/0279177 A1 | 9/2016 | Kelly et al. | |
| 2017/0143772 A1 | 5/2017 | Mulder et al. | |
| 2017/0143773 A1 | 5/2017 | Mulder et al. | |
| 2017/0143774 A1 | 5/2017 | Mulder et al. | |
| 2017/0173089 A1 | 6/2017 | Kelly | |
| 2017/0354695 A1 | 12/2017 | Grant et al. | |
| 2017/0368110 A1 | 12/2017 | Grant et al. | |

FOREIGN PATENT DOCUMENTS

| | | |
|---|---|---|
| CN | 101590081 A | 12/2009 |
| CN | 102940652 A | 2/2013 |
| CN | 103156888 A | 6/2013 |
| CN | 103981115 A | 8/2014 |
| CN | 102940652 B | 3/2015 |
| CN | 104546932 A | 4/2015 |
| CN | 104546933 A | 4/2015 |

(Continued)

OTHER PUBLICATIONS

Atarashi, K. et al., Treg induction by a rationally selected mixture of Clostridia strains from the human microbiota. Nature. 2013; 500(7461):232-236.
"Campeau, J.L. et al., Intestinal Epithelial Cells Modulate Antigen-Presenting Cell Responses to Bacterial DNA. Infectionand Immunity. Aug. 2012; 80(8): 2632-2644."
Chen, S. et al., Live combined bacillus subtilis and enterococcus faecium ameliorate murine experimental colitis by immunosuppression. International journal of inflammation. 2014(878054). 7 Pages.
Co-pending U.S. Appl. No. 15/357,850, filed Nov. 21, 2016.
Co-pending U.S. Appl. No. 15/357,936, filed Nov. 21, 2016.
Co-pending U.S. Appl. No. 15/359,144, filed Nov. 22, 2016.
Co-pending U.S. Appl. No. 15/359,972, filed Nov. 23, 2016.

(Continued)

*Primary Examiner* — David W Berke-Schlessel
(74) *Attorney, Agent, or Firm* — Wilson Sonsini Goodrich & Rosati

(57) ABSTRACT

The invention provides compositions comprising bacterial strains for treating and preventing inflammatory and autoimmune diseases.

23 Claims, 2 Drawing Sheets

(56) References Cited

FOREIGN PATENT DOCUMENTS

| | | |
|---|---|---|
| CN | 104546934 A | 4/2015 |
| CN | 104546935 A | 4/2015 |
| CN | 104546940 A | 4/2015 |
| CN | 104546942 A | 4/2015 |
| EP | 1448995 A1 | 8/2004 |
| EP | 2687227 A1 | 1/2014 |
| EP | 2810652 A2 | 12/2014 |
| EP | 2832859 A1 | 2/2015 |
| JP | H08259450 A | 10/1996 |
| JP | 2003261453 A | 9/2003 |
| JP | 2005097280 A | 4/2005 |
| JP | 2007084533 A | 4/2007 |
| JP | 2007116991 A | 5/2007 |
| JP | 2009507023 A | 2/2009 |
| JP | 2013527240 A | 6/2013 |
| JP | 2015500792 A | 1/2015 |
| KR | 20100128168 A | 12/2010 |
| WO | WO-9919459 A1 | 4/1999 |
| WO | WO-03046580 A1 | 6/2003 |
| WO | WO-2007027761 A2 | 3/2007 |
| WO | WO-2007136719 A2 | 11/2007 |
| WO | WO-2009027753 A1 | 3/2009 |
| WO | WO-2009072889 A1 | 6/2009 |
| WO | WO-2011110918 A1 | 9/2011 |
| WO | WO-2011149335 A1 | 12/2011 |
| WO | WO-2011152566 A2 | 12/2011 |
| WO | WO-2011153226 A2 | 12/2011 |
| WO | WO-2011153226 A3 | 3/2012 |
| WO | WO-2013008039 A2 | 1/2013 |
| WO | WO-2013050792 A1 | 4/2013 |
| WO | WO-2013080561 A1 | 6/2013 |
| WO | WO-2014001368 A1 | 1/2014 |
| WO | WO-2014067976 A1 | 5/2014 |
| WO | WO-2014075745 A1 | 5/2014 |
| WO | WO-2014078911 A1 | 5/2014 |
| WO | WO-2014121298 A2 | 8/2014 |
| WO | WO-2014121304 A1 | 8/2014 |
| WO | WO-2014137211 A1 | 9/2014 |
| WO | WO-2014145958 A2 | 9/2014 |
| WO | WO-2014167338 A1 | 10/2014 |
| WO | WO-2014201037 A2 | 12/2014 |
| WO | WO-2015006355 A2 | 1/2015 |
| WO | WO-2015013214 A2 | 1/2015 |
| WO | WO-2015021936 A1 | 2/2015 |
| WO | WO-2015095241 A2 | 6/2015 |
| WO | WO-2015156419 A1 | 10/2015 |
| WO | WO-2015169944 A1 | 11/2015 |
| WO | WO-2016019506 A1 | 2/2016 |
| WO | WO-2016102950 A1 | 6/2016 |
| WO | WO-2016102951 A1 | 6/2016 |

OTHER PUBLICATIONS

Duncan et al. (2002) "*Roseburia intestinal* is sp. nov., a novel saccharolytic, butyrate-producing bacterium from human faeces," International Journal System Evolutionary Microbiology. 52:1615-1620.

Duncan et al. (2006) "Proposal of *Roseburia faecis* sp. nov., *Roseburia hominis* sp. nov. and *Roseburia inulinivorans* sp. nov., based on isolates from human faeces," International Journal of Systematic and Evolutionary Microbiology.

FDA Orphan Drug Designations. Total Orphan Drugs website. Aug. 2014. Available at http://www.orphan-drugs.org/2014/09/01/fda-orphandrug-designations-august-2014. Accessed on Apr. 13, 2016.

GB Exam and search report dated Aug. 30, 2016 for GB Application No. 1520638.6.

GB Search and Exam report dated Mar. 31, 2016 for GB application 1510469.8.

GB Search and Exam report dated Mar. 31, 2016 for GB application 1510470.6.

GB Search and Exam report dated Apr. 15, 2016 for GB application 1510467.2.

GB Search and Exam report dated Apr. 20, 2016 for GB application 1510466.4.

GB Search and Exam report dated Apr. 20, 2016 for GB application 1510468.0.

GB Search and Exam report dated Aug. 31, 2016 for GB application No. 1520631.1.

GB Search and Exam report dated Nov. 17, 2016 for GB application 1520502.4.

GB Search and Exam report dated Sep. 13, 2016 for GB application 1520497.7.

Ghadimi, D. et al., Epigenetic imprinting by commensal probiotics inhibits the IL-23/IL-17 axis in an in vitro model of the intestinal mucosal immune system. JLB. 2012;92(4):895-911.

International Search Report dated Jan. 27, 2017 for International Application No. PCT/GB2016/053622.

International Search Report dated Aug. 26, 2016 for International application No. PCT/GB2016/051774.

International Search Report dated Aug. 26, 2016 for International application No. PCT/GB2016/051776.

International Search Report dated Sep. 6, 2016 for International application No. PCT/GB2016/051768.

International Search Report dated Sep. 6, 2016 for International application No. PCT/GB2016/051773.

International Search Report dated Sep. 6, 2016for International application No. PCT/GB2016/051770.

International Search Report dated Feb. 2, 2017 for International application No. PCT/GB2016/053620.

Kitahara, M. et al., *Bacteroides plebeius* sp. nov. and *Bacteroides coprocola* sp. nov., isolated from human faeces. International journal of systematic and evolutionary microbiology. 2005; 55: 2143-2147.

Kverka, M. et al., Oral administration of Parabacteroides distasonis antigens attenuates experimental murine colitis through modulation of immunity and microbiota composition. Clinical & Experimental Immunology. 2010; 163:250-259.

Lodemann, U. et al., Effects of the Probiotic enterococcus faecium and pathogenic *Escherichia coli* strains in a pig and human epithelial intestinal cell model. Hindawi publishing corporation scientifica. 2015(235184) 10 pages.

Miyake, T. et al., Phylogenetic Analysis of the Genus *Bifidobacterium* and Related Genera Based on 16S rDNA Sequences. Microbiol. Immunol. 1998; 42(10):661-667.

Overstreet et al. 'Dysbiosis Characterized by Reduced Abundance of Roseburia is Associated With Increased Severity of Colitis in IL-10-/-Mice'. Gastroenterology. 2011, vol. 140, No. 5, Suppl. 1, pp. S-696.

Park, S.K. et al., *Blautia stercoris* sp. nov., isolated from human faeces. International journal of systematic and evolutionary microbiology. 2012; 62(4): 776-779.

Patel., R. et al., Determination of 16S rRNA sequences of enterococci and application to species identification of nonmotile enterococcus gallinarum isolates. Journal of clinical microbiology, 1998; 36(11):3399-3407.

Sakamoto, M. et al., Reclassification of Bacteroides distasonis, Bacteroides goldsteinii and Bacteroides merdae as *Parabacteroides distasonis* gen. nov., comb. nov., *Parabacteroides goldsteinii* comb. nov. and *Parabacteroides merdae* comb. nov. International journal of systematic and evolutionary microbiology. 2006; 56: 1599-1605.

Sisson, G. et al., Randomised clinical trial: a liquid multi-strain probiotic vs. placebo in the irritable bowel syndrome—a 12 week double-blind study. Aliment Pharmacol Ther. 2014; 40: 51-62.

Sivieri, K. et al., Probiotic enterococcus faecium CRL 183 inhibit chemically induced colon cancer in male wistar rats. Eur Food Res Technol. 2008; 228:231-237.

Tesmer, LA. et al., Th17 cells in human disease. Immunol Rev. 2008;223:87-113.

Toomer, O. et al., Maternal and postnatal dietary probiotic supplementation enhances splenic regulatory T helper cell population and reduces peanut allergen-induced hypersensitivity responses in mice. Immunobiology. 209; 2014: 661-670.

Wunderlich, P.F. et al., Double-blind report on the efficacy of lactic acid-producing enterococcus SF68 in the prevention of antibiotic-

(56) References Cited

OTHER PUBLICATIONS associated diarrhoea and in the treatment of acute diarrhoea. The journal of international medical research. 1989; 17: 333-338.
Zhang, B. et al., Oral administration of enterococcus faecalis FK-23 suppresses Th17 cell development and attenuates allergic airway responses in mice. International journal of molecular medicine. 2012; 30:248-254.
Zheng, B. et al., Bifidobacteriu breve attenuates murine dextran sodium sulfate-induced colitis and increases regulatory T cell responses. PLOS one. May 2014; 9(5).
Zhongyuan, T. et al., The inflammation regulation effects of enterococcus faecium HDRsEf1 on human enterocyte-like HT-29 cells. Animal cells and systems. Mar. 2016;20(2):70-76.
Zitomersky, N. et al., Characterization of Adherent Bacteroidales from Intestinal Biopsies of Children and Young Adults with Inflammatory Bowel Disease. PLOS one. 2013; 8(6).
Atarashi et al., Th17 Cell Induction by Adhesion of Microbes to Intestinal Epithelial Cells. Cell, vol. 163, No. 2, Oct. 8, 2015. pp. 367-380.
Dahya V. et al., Clostridium ramosum Osteomyelitis in an immunocompetent patient after traumatic injury, Infectious Diseases in Clinical Practice 20150312 Lippincott Williams and Wilkins USA, vol. 23, No. 2, Mar. 12, 2015, pp. 102-104, XP009193312, ISSN: 1056-9103 the whole document.
Farooq, P.D. et al., Pseudomembranous colitis, Disease-A-Month 2015 Mosby Inc. USA, vol. 61, No. 5, May 1, 2015, pp. 181-206, XP009193313, ISSN: 0011-5029 p. 195.
International Search Report dated Feb. 17, 2017 for International Application No. PCT/GB2016/053676.
International Search Report dated Mar. 6, 2017 for International Application No. PCT/GB2016/053677.
Kanauchi, et al., Eubacterium limosum ameliorates experimental colitis and metabolite of microbe attenuates colonic inflammatory action with increase of mucosal integrity introduction, China World J Gastroenterol Feb., Jan. 1, 2006. pp. 1071-1077.
Schwiertz, et al., Quantification of Different *Eubacterium* spp. in Human Fecal Samples with Species-Specific 16S rRNA-Targeted Oligonucleotide Probes. Applied and environmental biology, vol. 66, No. 1, Jan. 1, 2000; pp. 375-382.
Severijnen, et al., Chronic Arthritis Induced in Rats by Cell Wall Fragments of *Eubacterium* Species from the Human Intestinal Flora. Infection and Immunity, Feb. 1990; 58(2): p. 523-528.
Udayappan, et al., Oral treatment with Eubacterium hallii improves insulin sensitivity in db/db mice. NPJ Biofilms and microbiomes, vol. 2, Jul. 6, 2016; p. 16009.
Udayappan et al., PS4-5. Administration of Eubacterium hallii improves insulin sensitivity and degree of liversteatosis in male db/db mice. Nederlands tijdschrift voor diabetologie, vol. 11, No. 4., Nov. 23, 2013.pp. 145.
"Amedei, A. et al. Multiple sclerosis: the role of cytokines in pathogenesis and in therapies. Int J Mol Sci. Oct. 19, 2012;13(10):13438-60. doi: 10.3390/ijms131013438."
Atlas, R. Handbook of Microbiological Media, Fourth Edition. CRC Press. 2010.
Azad, M.B. et al., Probiotic supplementation during pregnancy or infancy for the prevention of asthma and wheeze: systematic review and meta-analysis BMJ 2013; 347 :f6471.
Bagge, et al., Diversity of spore-forming bacteria in cattle manure, slaughterhouse waste and samples from biofas plants. Journal of applied material. Jan. 2010.
Balato, et al., Effects of adalimumab therapy in adult subjects with moderate-to-severe psoriasis on Th17 pathway. (2014) J Eur Acad Dermatol Venereol. 28(8):1016-24.
Bertram, J. et al. Establishment of a cloned line of Lewis lung carcinoma cells adapted to cell culture. (1980) Cancer let. 11:63-73.
Birdi, K.S. Handbook of Surface and Colloid Chemistry, 2nd Edition. CRC Press. 1997.

Busing, K. et al., Effects of oral Enterococcus faecium strain DSM 10663 NCIMB 10415 on diarrhoea patterns and performance of sucking piglets. Benef Microbes. Mar. 2015;6(1):41-4. doi: 10.3920/BM2014.0008.
Caspi, P.R. Experimental autoimmune uveoretinitis in the rat and mouse. Curr Protoc Immunol. May 2003;Chapter 15:Unit 15.6. doi: 10.1002/0471142735.im1506s53.
Cheluvappa, R. et al., T helper type 17 pathway suppression by appendicitis and appendectomy protects against colitis. Clin Exp Immunol. Feb. 2014;175(2):316-22. doi: 10.1111/cei.12237.
Chi, W. et al., IL-23 promotes CD4+ T cells to produce IL-17 in Vogt-Koyanagi-Harada disease. J Allergy Clin Immunol. May 2007;119(5):1218-24. Epub Mar. 1, 2007.
Chi, W. et al. Upregulated IL-23 and IL-17 in Behçet patients with active uveitis. Invest Ophthalmol Vis Sci. Jul. 2008;49(7):3058-64. doi: 10.1167/iovs.07-1390.
Collins, M.D., et al., *Enterococcus avium* nom. rev., comb. nov.; *E. casseliflavus* nom. rev., comb. nov.; *E. durans* nom. rev., comb. nov.; *E. gallinarum* comb. nov.; and *E. malodoratus* sp. nov. (1984) Int J Syst Evol Microbiol. 34: 220-223.
Darlington, G.J., Liver Cell Lines. (1987) Meth Enzymol. 151:19-38.
Day, J.G. et al., Cryopreservation and Freeze-Drying Protocols. Springer. 2007. 2nd edition.
Divyashri et al. Probiotic attributes, antioxidant, anti-inflammatory and neuromodulatory effects of Enterococcus faecium CFR 3003: in vitro and in vivo evidence. (2015) J Med Microbiol. doi: 10.1099/jmm.0.000184.
Eckburg, PB. et al., Diversity of the human intestinal microbial flora.Science. Jun. 10, 2005;308(5728):1635-8. Epub Apr. 14, 2005.
Fabro, A. et al., The Th17 pathway in the peripheral lung microenvironment interacts with expression of collagen V in the late state of experimental pulmonary fibrosis. (2015) Immunobiology. 220(1):124-35.
Faghih, Z. et a., IL-17 and IL-4 Producing CD8+ T Cells in Tumor Draining Lymph Nodes of Breast Cancer Patients: Positive Association with Tumor Progression. (2013). Iranian Journal of Immunology. 10(4):193-204.
Fahy, J.V. Eosinophilic and neutrophilic inflammation in asthma: insights from clinical studies. Proc Am Thorac Soc. May 1, 2009;6(3):256-9. doi: 10.1513/pats.200808-087RM.
Frank, D. et al., Molecular-phylogenetic characterization of microbial community imbalances in human inflammatory bowel diseases. 2007. PNAS. 104(34):13780-5.
Gennaro, A.R., Remington: The Science and practice of pharmacy. 20th edition. 2000.
Goldin, B.R. et al., Clinical indications for probiotics: an overview. Clin Infect Dis. Feb. 1, 2008;46 Suppl 2:S96-100; discussion S144-51. doi: 10.1086/523333.
Guide for the care and use of laboratory animals: 8th edition. The national academic press; 2011.
Haabeth et al. A model for cancer-suppressive inflammation. (2012) Oncolmmunology 1(1):1146-1152.
Hammerich, L. et al., Interleukins in chronic liver disease: lessons learned from experimental mouse models. (2014) Clin Exp Gastroenterol. 7:297-306.
Holdeman, et al., *Eubacterium contortum* (Prevot) comb. nov.: Emendation of description and designation of the type strain. International journal of systematic bacteriology. Oct. 1971;21(4): 304-306.
Ispirli, H. et al., Characterization of functional properties of Enterococcus faecium strains isolated from human gut. Characterization of functional properties of Enterococcus faecium strains isolated from human gut.
Jawad, S. et al., Elevated serum levels of interleukin-17A in uveitis patients. Ocul Immunol Inflamm. Dec. 2013;21(6):434-9. doi: 10.3109/09273948.2013.815786. Epub Aug. 19, 2013.
Kallasapathy, K. Microencapsulation of Probiotic Bacteria:Technology and Potential Applications. Curr. Issues Intest. Microbiol. (2002) 3: 39-48.
Kanauchi, et al., Eubacterium limosum (probiotic) and its metabolites showed anti-inflammatory effects and increased mucosal barrier function in colitis. S1912.

(56) References Cited

OTHER PUBLICATIONS

Kang, S. et al., Dysbiosis of fecal microbiota in Crohn's disease patients as revealed by a custom phylogenetic microarray.Inflamm Bowel Dis. Dec. 2010;16(12):2034-42. doi: 10.1002/ibd.21319.

Karaffova, et al., Interaction of TGF-B4 and IL-17 with IgA secretion in the intestine of chickens fed with E. faecium AL41 and challenged with S. Enteritidis. Research in Veterinary science. 2015:75-79.

Karin, M. Nuclear factor-kappaB in cancer development and progression. Nature. May 25, 2006;441(7092):431-6.

Koenders, M.I. et al., Interleukin-17 Acts Independently of TNF-a under Arthritic Conditions. (2006) J. Immunol. 176:6262-6269.

Laukova, A. et al. Benefits of Combinative Application of Probiotic, Enterocin M-Producing Strain Enterococcus Faecium AL41 and Eleutherococcus Senticosus in Rabbits. Folia Microbiol (Praha) 61 (2), 169-177. Sep. 9, 2015.

Lejeune, FJ. et al., Efficiency of Recombinant Human TNF in Human Cancer Therapy. (2006) Cancer Immun. 6:6.

Leslie, et al., Trehalose and sucrose protect both membranes and proteins in intact bacteria during drying. (1995) Appl. Environ. Microbiol. 61, 3592-3597.

Luger, D. and Caspi, R.R., New perspectives on effector mechanisms in uveitis. (2008) Semin. Immunopathol. 30(2): 134-143.

Machiels, K. A decrease of the butyrate-producing species *Roseburia hominis* and *Faecalibacterium prausnitzii* defines dysbiosis in patients with ulcerative colitis.Gut. Aug. 2014;63(8):1275-83. doi: 10.1136/gutjnl-2013-304833. Epub Sep. 10, 2013.

MacPherson, AJ. et al., IgA responses in the intestinal mucosa against pathogenic and non-pathogenic microorganisms. Oct. 2001. 3(12). 1021-1035.

MacPherson, AJ., et al., The functions of mucosal T cells in containing the indigenous commensal flora of the intestine.Cell Mol Life Sci. Dec. 2002;59(12):2088-96.

Mansour et al. Isolation of Enterococcus faecium NM113, Enterococcus faecium NM213 and Lactobacillus casei NM512 as novel probiotics with immunomodulatory properties. (2014) Microbiol Immun. 58(10):559-69.

Masco, L., et al., Identification of *Bifidobacterium* Species Using rep-PCR Fingerprinting. Systematic and Applied Microbiology 26(4):557-63 • Dec. 2003.

Maya, J.R. et al., Emerging Therapies for Noninfectious Uveitis: What May Be Coming to the Clinics. (2014) J. Ophthalmology. 310329.

Mazmanian, SK., An immunomodulatory molecule of symbiotic bacteria directs maturation of the host immune system.Cell. Jul. 15, 2005;122(1):107-18.

Miossec, P. et al. Targeting IL-17 and TH17 cells in chronic inflammation. Nat Rev Drug Discov. Oct. 2012;11(10):763-76. doi: 10.1038/nrd3794.

Mitropoulou, G. et al. Immobilization Technologies in Probiotic Food Production. (2013) Journal Nutr Metab. (2013) 716861.

Miyamoto-Shinohara, Y. et al., Survival of freeze-dried bacteria. J Gen Appl Microbiol. Feb. 2008;54(1):9-24.

Monteleone, I. et al., Th17-related cytokines: new players in the control of chronic intestinal inflammation. (2011) BMC Medicine. 2011, 9:122.

Mucientes, A. et al., Specific association of IL17A genetic variants with panuveitis. (2015) Br J Ophthalmol. 99(4):566-70.

Numasaki, M. et al., IL-17 Enhances the Net Angiogenic Activity and In Vivo Growth of Human Non-Small Cell Lung Cancer in SCID Mice through Promoting CXCR-2-Dependent Angiogenesis. (2005) J. Immunol. 175: 6177-6189.

Numasaki, M. et al., Interleukin-17 promotes angiogenesis and tumor growth. Blood. Apr. 1, 2003;101(7):2620-7. Epub Oct. 31, 2002.

Pace et al. Macrophage activiation: Priming activity from a T-cell hybridoma is attributable to interferon. (1983) PNAS. 80:3782-6.

Rockwell, S.C. et al., Characteristics of a Serially Transplanted Mouse Mammary Tumor and Its Tissue-Culture-Adapted Derivative. (1972) J Natl Cancer Inst. 49:735-49.

Sambrook, J.F. et al., Molecular Cloning: A Laboratory Manual, 3rd ed. Cold spring harbor laboratory press. 2001.

Scanlan PD., et al., Culture-independent analyses of temporal variation of the dominant fecal microbiota and targeted bacterial subgroups in Crohn's disease. J Clin Microbiol. Nov. 2006;44(11):3980-8. Epub Sep. 20, 2006.

Schieck, M. et al., Genetic variation in TH17 pathway genes, childhood asthma, and total serum IgE levels.(2014) J Allergy Clin Immunol. 133(3):888-91.

Schleifer, K.H. et al., Transfer of *Streptococcus faecalis* and *Streptococcus faecium* to the Genus *Enterococcus* nom. rev. as *Enterococcus faecalis* comb. nov. and *Enterococcus faecium* comb. nov. Int J Syst Evol Microbiol, Jan. 1984 34: 31-34, doi:10.1099/00207713-34-1-31.

Schmitz, S. et al., A prospective, randomized, blinded, placebo-controlled pilot study on the effect of Enterococcus faecium on clinical activity and intestinal gene expression in canine food-responsive chronic enteropathy. J Vet Intern Med. Mar.-Apr. 2015;29(2):533-43. doi: 10.1111/jvim.12563. Epub Mar. 16, 2015.

Severijnen, A. J. et al., Chronic Arthritis Induced in Rats by Cell Wall Fragments of *Eubacterium* Species from the Human Intestinal Flora. Infection and Immunity, 1990, vol. 58, No. 2, 523-528.

Sgadari, C. et al., Interferon-inducible protein-10 identified as a mediator of tumor necrosis in vivo. (1996) PNAS. 93:13791-6.

Sgadari et al. Mig, the Monokine Induced by Interferon-g, Promotes Tumor Necrosis In Vivo. (1997) Blood. 89:2635-43.

Shabgah, A.G. et al., Interleukin-17 in human inflammatory diseases. Postepy Dermatol Alergol. Aug. 2014; 31(4): 256-261.

Simpson-Herren, L. et al., Kinetic parameters and growth curves for experimental tumor systems. Cancer Chemother Rep. Jun. 1970;54(3):143-74.

Smith, T.F. et al., Comparison of biosequences. (1981) Adv. Appl. Math. 2: 482-489.

Spor, A. et al., Unravelling the effects of the environment and host genotype on the gut microbiome. Nat Rev Microbiol. Apr. 2011;9(4):279-90. doi: 10.1038/nrmicro2540.

Srutkova, D. et al., Efficiency of PCR-based methods in discriminating *Bifidobacterium longum* ssp. *longum* and *Bifidobacterium longum* ssp. *infantis* strains of human origin.J Microbiol Methods. Oct. 2011;87(1):10-6. doi: 10.1016/j.mimet.2011.06.014. Epub Jul. 2, 2011.

Strickertsson, J.A. et al., Enterococcus faecalis Infection and Reactive Oxygen Species Down-Regulates the miR-17-92 Cluster in Gastric Adenocarcinoma Cell Culture. Genes 2014, 5(3), 726-738.

Strobel, H.J. Basic laboratory culture methods for anaerobic bacteria. Methods Mol Biol. 2009;581:247-61. doi: 10.1007/978-1-60761-214-8_16.

Sun, D. et al., The role of Th17-associated cytokines in the pathogenesis of experimental autoimmune uveitis (EAU). (2015) Cytokine. 74(1):76-80.

Tsukinowa, et al., Fecal microbiota of a dugong (*Dugong dugong*) in captivity at Toba Aquarium. J. Gen. Appl. Microbiol., 54, 25-38 (2008).

Workman et al. Guidelines for the welfare and use of animals in cancer research (2010) Br. J. Cancer. 102:1555-77.

Yang, J. et al., Targeting Th17 cells in autoimmune diseases. Trends Pharmacol Sci. Oct. 2014;35(10):493-500. doi: 10.1016/j.tips.2014. 07.006. Epub Aug. 14, 2014.

Ye, X. et al., The Role of IL-23/Th17 Pathway in Patients with Primary Immune Thrombocytopenia. (2015) PLoS One. 10(1):e0117704.

Yin, X. et al., Combined effect of five single nucleotide polymorphisms related to IL23/Th17 pathway in the risk of psoriasis.Immunogenetics. Mar. 2014;66(3):215-8. doi: 10.1007/s00251-013-0756-z. Epub Jan. 14, 2014.

Yutin, N. and Galperin, M.Y., A genomic update on clostridial phylogeny:Gram-negative spore formers and other misplaced clostridia. Environmental microbiology. 20136; 15(10): 2631-2641.

(56) References Cited

OTHER PUBLICATIONS

Zhang, B. et al., The Prevalence of Th17 Cells in Patients With Gastric Cancer. 2008. Biochem Biophys Res Commun 374 (3), 533-537.
Zhang, et al., The Activation of NF-κB in Infiltrated Mononuclear Cells Negatively Correlates with Treg Cell Frequency in Oral Lichen Planus. Inflammation. Aug. 2015;38(4):1683-9. doi: 10.1007/s10753-015-0145-x.
Zitvogel, et al., Type I interferons in anticancer immunity. Nature Reviews. Jul. 2015:405-414.
Arenberg, et al., Interferon-γ-inducible Protein 10 (IP-10) Is an Angiostatic Factor That Inhibits Human Non-small Cell Lung Cancer (NSCLC) Tumorigenesis and Spontaneous Metastases. 1996. J. Exp.Med. 184:981-92.
Gennaro, A.R., Remington's Pharmaceutical sciences, Mack publishing co. 1985.
Ausubel, et al. Current Protocols in Molecular Biology. 1987. Supplement 30.
Ausubel et al., Short protocols in molecular biology. Fifth edition, 2002.
Brand et al., Collagen-induced arthritis, 2007; Protocol 2(5):1269-1275.
Co-pending U.S. Appl. No. 15/592,178, filed May 10, 2017.
Co-pending U.S. Appl. No. 15/631,945, filed Jun. 23, 2017.
Co-pending U.S. Appl. No. 15/631,952, filed Jun. 23, 2017.
Co-pending U.S. Appl. No. 15/673,270, filed Aug. 9, 2017.
Co-pending U.S. Appl. No. 15/679,857, filed Aug. 17, 2017.
Jiao et al., Blockade of Notch Signaling Ameliorates Murine Collagen-Induced Arthritis via Suppressing Th1 and Th17 Cell Responses. 2014; Pathology, 184(4):1085-1091.
Manni et al., A tale of two cytokines: IL-17 and IL-22 in asthma and infection. Expert Rev Respir Med. Feb. 2014 ; 8(1): 25-42. doi:10.1586/17476348.2014.854167.
Miossec et al., Targeting IL-17 and TH17 cells in chronic inflammation, 2012; Nature Drug Discovery 11, 763-776.
Mukai et al., SH3BP2 Gain-Of-Function Mutation Exacerbates Inflammation and Bone Loss in a Murine Collagen-Induced Arthritis Model, 2014 PLoS ONE 9(8): e105518.
Office Action dated Jan. 11, 2005 for U.S. Appl. No. 10/285,224.
Office Action dated Jan. 26, 2009 for U.S. Appl. No. 10/275,706.
Office Action dated Feb. 18, 2010 for U.S. Appl. No. 10/285,224.
Office Action dated Mar. 13, 2013 for U.S. Appl. No. 12/760,926.
Office Action dated Mar. 26, 2007 for U.S. Appl. No. 10/275,706.
Office Action dated Apr. 4, 2008 for U.S. Appl. No. 10/285,224.
Office Action dated May 2, 2007 for U.S. Appl. No. 10/285,224.
Office Action dated May 2, 2008 for U.S. Appl. No. 10/275,706.
Office Action dated May 25, 2016 for U.S. Appl. No. 14/249,710.
Office Action dated May 26, 2009 for U.S. Appl. No. 10/285,224.
Office Action dated May 26, 2017 for U.S. Appl. No. 15/357,850.
Office Action dated May 30, 2006 for U.S. Appl. No. 10/285,224.
Office Action dated Jun. 26, 2017 for U.S. Appl. No. 15/357,936.
Office Action dated Jul. 6, 2017 for U.S. Appl. No. 15/070,605.
Office action dated Jul. 8, 2015 for U.S. Appl. No. 14/349,907.
Office Action dated Aug. 10, 2017 for U.S. Appl. No. 15/357,850.
Office Action dated Aug. 21, 2013 for U.S. Appl. No. 12/760,926.
Office Action dated Sep. 4, 2015 for U.S. Appl. No. 14/249,710.
Office Action dated Sep. 17, 2010 for U.S. Appl. No. 10/285,224.
Office Action dated Oct. 12, 2005 for U.S. Appl. No. 10/285,224.
Office Action dated Oct. 28, 2009 for U.S. Appl. No. 10/275,706.
Office Action dated Oct. 30, 2008 for U.S. Appl. No. 10/285,224.
Office Action dated Nov. 6, 2006 for U.S. Appl. No. 10/285,224.
Office Action dated Nov. 23, 2015 for U.S. Appl. No. 14/232,475.
Office Action dated Dec. 13, 2012 for U.S. Appl. No. 12/760,926.
Office Action dated Dec. 19, 2005 for U.S. Appl. No. 10/275,706.
Scher et al., Expansion of intestinal Prevotella copri correlates with enhanced susceptibility to arthritis. 2013; eLIFE 2, e01202, 20 Pages.
Song et al., Impact of Schistosoma japonicum Infection on Collagen-Induced Arthritis in DBA/1 Mice: A Murine Model of Human Rheumatoid Arthritis. 2011; PLoS ONE 6, e23453, 10 pages.
Stoll et al., Altered microbiota associated with abnormal humoral immune responses to commensal organisms in enthesitis-related arthritis, 2014; Arthritis Res Ther. 16:486.
Vetrovsky, T. and Baldrian, P., The variability of the 16S rRNA gene in bacterial genomes and its consequences for bacterial community analyses. Plos One. Feb. 2013; 8(2): e57923.
Atarashi, et al., Treg induction by a rationally selected mixture of Clostridia strains from the human microbiota. Supplementary Information. Nature 500, 232-236 (Aug. 8, 2013) doi:10.1038/nature12331.
Bottacini, et al., Comparative genomics of the Bifidobacterium brevetaxon. BMC Genomics, 2014; 15:170. DOI:10.1186/1471-1471-2164-15-170.
Cekanaviciute, et al., Gut bacteria from multiple sclerosis patients modulate human T cells and exacerbate symptoms in mouse models. PNAS. Jun. 30, 2017; 1-6.
Chiu, et al., Monocolonization of germ-free mice with bacteroides fragilis protects against dectran sulfate sodium-induced acute colitis. Biomed Research International 2014. vol. 2014. Article ID 675786. 9 Pages.
Co-pending U.S. Appl. No. 15/704,245, filed Sep. 14, 2017.
Co-pending U.S. Appl. No. 15/803,721, filed Nov. 3, 2017.
Co-pending U.S. Appl. No. 15/803,723, filed Nov. 3, 2017.
Co-pending U.S. Appl. No. 15/842,635, filed Dec. 14, 2017.
Fenner, et al., *Bacteroides massiliensis* sp. nov., isolated from blood culture of a newborn. International Journal of systematic and evolutionary microbiology, 2005. 55: 1335-1337.
Hougee, et al., Oral treatment with probiotics reduces allergic symptoms in ovalbumin-sensitized mice: a bacterial strain comparative study. Int Arch Allergy Immunol. 2010; 151:107-117.
Lyons, et al., Bacterial strain-specific induction of Foxp3 T regulatory cells is protective in murine allergy models. Clinical & Experimental Allergy. 2010; 40:811-819.
MacSharry et al., Immunomodulatory effects of feeding with bifidobacterium longum on allergen-induced lung inflammation in the mouse. Pulmonary pharmacology & Therapeutics. 2012; 25:325-334.
Miyauchi, E., Control of multiple sclerosis by gut microbiota. Journal of clinical and experimental medicine. 2015. vol. 253 No. 5.2, pp. 445-450.
Narushima, et al., Characterization of the 17 strains of regulatory T cell-inducing human-derived Clostridia. Gut Microbes Mar. 18, 2014; 5:3, 333-339.
Notice of allowance dated Sep. 1, 2017 for U.S. Appl. No. 15/357,850.
Office Action dated Jan. 2, 2018 for U.S. Appl. No. 15/357,936.
Office Action dated Nov. 2, 2017 for U.S. Appl. No. 15/700,007.
Office Action dated Nov. 24, 2017 for U.S. Appl. No. 15/359,972.
Office Action dated Nov. 24, 2017 for U.S. Appl. No. 15/679,857.
Office Action dated Dec. 6, 2017 for U.S. Appl. No. 15/592,178.
Oladipo, et al., Bioprotective potential of bacteriocinogenic enterococcus gallinarum strains isolated from some Nigerian fermented foods, and of their bacteriocins. Polish Journal of Microbiology. 2014; 63(4): 415-422.
Parabacteroides distasonis (Eggerth and Gagnon) Sakamoto and Benno (ATCC 8503). Sep. 19, 2017. 2 Pages.
Sagar, et al., Bifidobacterium breve and lactobacillus rhamnosus treatment is as effective as budesonide at reducing inflammation in a murine model for chronic asthma. Respiratory Research. 2014; 15(46):1-17.
Schouten, et al., Cow milk allergy symptoms are reduced in mice fed dietary synbiotics during oral sensitization with whey. Nutritional Immunology. 2015; 139(7):1390-403.
Stanton et al. (1983) "*Roseburia cecicola* gen. nov., sp. nov., a Motile, Obligately Anaerobic Bacterium from a Mouse Cecum," Int. J. Syst. Bacterial. 33:618-627.
Tanaka, K. and Watanabe, K., In Vitro tebipenem activity against anaerobic bacteria. Japanese Journal of Chemotherapy. Mar. 2009. vol. 57 S-1.
Van De Veerdonk, et al., The Anti-CD20 antibody rituximab reduces the Th17 cell response. Arthritis & Rheumatism. Jun. 2011; 63(6):1507-1516.

(56) References Cited

OTHER PUBLICATIONS

Zhu, S. and Qian, Y., IL-17/IL-17 receptor system in autoimmune disease: mechanisms and therapeutic potential. Clinical Science (2012) 122, 487-511.
Banfield, J. & Murphy, K.R., Non-Th2, Late-onset, non-allergic asthma. Copd & Asthma for NPs, a peer-reviewed newsletter, Aug. 2016; 14: 8 Pages.
Charriot, et al., Future treatment for ashtma, Eur Respir Rev 2016; 25: 77-92.
Demarche, et al., Detailed analysis of sputum and systemic inflammation in asthma phenotypes: are paucigranulocytic asthmatics really non-inflammatory?, BMC Pulmonary Medicine, 2016; (16)46: 1-13.
Mazmanian et al. 'An immunomodulatory molecule of symbiotic bacteria directs maturation of the host immune system.' Cell. 2005, vol. 122, No. 1, pp. 107-118.

\* cited by examiner

COMPOSITIONS COMPRISING BACTERIAL STRAINS

SEQUENCE LISTING

The instant application contains a Sequence Listing which has been submitted electronically in ASCII format and is hereby incorporated by reference in its entirety. Said ASCII copy, created on Jan. 24, 2017, is named 49455_711_201_P067605XX_sequence_listing.txt and is 1,261,788 bytes in size.

CROSS REFERENCE

This application claims priority to GB Application No. 1520631.1, filed on Nov. 23, 2015, which is herein incorporated by reference in its entirety.

TECHNICAL FIELD

This invention is in the field of compositions comprising bacterial strains isolated from the mammalian digestive tract and the use of such compositions in the treatment of disease.

BACKGROUND TO THE INVENTION

The human intestine is thought to be sterile in utero, but it is exposed to a large variety of maternal and environmental microbes immediately after birth. Thereafter, a dynamic period of microbial colonization and succession occurs, which is influenced by factors such as delivery mode, environment, diet and host genotype, all of which impact upon the composition of the gut microbiota, particularly during early life. Subsequently, the microbiota stabilizes and becomes adult-like [1]. The human gut microbiota contains more than 500-1000 different phylotypes belonging essentially to two major bacterial divisions, the Bacteroidetes and the Firmicutes [2]. The successful symbiotic relationships arising from bacterial colonization of the human gut have yielded a wide variety of metabolic, structural, protective and other beneficial functions. The enhanced metabolic activities of the colonized gut ensure that otherwise indigestible dietary components are degraded with release of by-products providing an important nutrient source for the host. Similarly, the immunological importance of the gut microbiota is well-recognized and is exemplified in germ-free animals which have an impaired immune system that is functionally reconstituted following the introduction of commensal bacteria [3-5].

Dramatic changes in microbiota composition have been documented in gastrointestinal disorders such as inflammatory bowel disease (IBD). For example, the levels of *Clostridium* cluster XIVa bacteria are reduced in subjects with IBD whilst numbers of *E. coli* are increased, suggesting a shift in the balance of symbionts and pathobionts within the gut [6-9]. Interestingly, this microbial dysbiosis is also associated with imbalances in T effector cell populations.

In recognition of the potential positive effect that certain bacterial strains may have on the animal gut, various strains have been proposed for use in the treatment of various diseases (see, for example, [10-13]). Also, certain strains, including mostly *Lactobacillus* and *Bifidobacterium* strains, have been proposed for use in treating various inflammatory and autoimmune diseases that are not directly linked to the intestines (see [14] and [15] for reviews). However, the relationship between different diseases and different bacterial strains, and the precise effects of particular bacterial strains on the gut and at a systemic level and on any particular types of diseases, are poorly characterized.

Seres Health, Inc. (see [16]) speculates that bacteria obtained from faecal samples may be useful for treating immune system disorders but no guidance are provided as to which bacteria would be effective.

Honda et al. (see [17]) describes how a mixture of 20 bacteria of different genera, including species from the *Clostridium* genus, induce the proliferation and accumulation of Th17 cells. Honda et al.'s compositions are said to be useful for improving immune functions and preventing or treating infectious diseases. However, Honda et al. teaches that in order to treat autoimmune and inflammatory disease in an individual, the Th17-inducing bacteria should be inhibited or killed, for example, by administering an antibiotic to the subject.

There is a requirement in the art for new methods of treating inflammatory and autoimmune diseases. There is also a requirement for the potential effects of gut bacteria to be characterized so that new therapies using gut bacteria can be developed.

SUMMARY OF THE INVENTION

The inventors have developed new therapies for treating and preventing inflammatory and autoimmune diseases. In particular, the inventors have developed new therapies for treating and preventing diseases and conditions mediated by IL-17 or the Th17 pathway. In particular, the inventors have identified that bacterial strains from the genus *Erysipelatoclostridium* can be effective for treating and preventing diseases and conditions mediated by IL-17 or the Th17 pathway. As described in the examples, oral administration of compositions comprising *Erysipelatoclostridium ramosum* may reduce the severity of the inflammatory response, including the Th17 inflammatory response, in mouse models of uveitis.

Therefore, in a first embodiment, the invention provides a composition comprising a bacterial strain of the genus *Erysipelatoclostridium*, for use in a method of treating or preventing a disease or condition mediated by IL-17 or the Th17 pathway. The inventors have identified that treatment with bacterial strains from this species can provide clinical benefits in mouse models of inflammatory and autoimmune diseases mediated by IL-17 and the Th17 pathway, may reduce levels of cytokines that are part of the Th17 pathway, including IL-17, and may alleviate the Th17 inflammatory response.

In particular embodiments, the invention provides a composition comprising a bacterial strain of the genus *Erysipelatoclostridium*, for use in a method of treating or preventing a disease or condition selected from the group consisting of: uveitis; cancer, such as breast cancer, lung cancer, liver cancer, colon cancer, or ovarian cancer; multiple sclerosis; arthritis, such as rheumatoid arthritis, osteoarthritis, psoriatic arthritis, or juvenile idiopathic arthritis; neuromyelitis optica (Devic's disease); ankylosing spondylitis; spondyloarthritis; psoriasis; systemic lupus erythematosus; inflammatory bowel disease, such as Crohn's disease or ulcerative colitis; celiac disease; asthma, such as allergic asthma or neutrophilic asthma; chronic obstructive pulmonary disease (COPD); scleritis; vasculitis; Behcet's disease; atherosclerosis; atopic dermatitis; emphysema; periodontitis; allergic rhinitis; and allograft rejection. The effect shown for the bacterial strains from the genus *Erysipelatoclostridium* on the Th17 inflammatory response and on diseases mediated by IL-17 and the Th17 pathway may provide therapeutic benefits for other diseases and conditions mediated by IL-17 and the Th17 pathway, such as those listed above.

In particularly preferred embodiments, the invention provides a composition comprising a bacterial strain of the genus *Erysipelatoclostridium*, for use in a method of treating or preventing uveitis, such as posterior uveitis. The inventors have identified that treatment with *Erysipelatoclostridium* strains can reduce disease incidence and disease severity in a mouse model of uveitis and can prevent or reduce retinal damage. In preferred embodiments, the invention provides a composition comprising a bacterial strain of the species *Erysipelatoclostridium ramosum*, for use in the treatment of uveitis. Compositions using *Erysipelatoclostridium ramosum* may be particularly effective for treating uveitis.

In further preferred embodiments, the invention provides a composition comprising a bacterial strain of the genus *Erysipelatoclostridium*, for use in a method of treating or preventing asthma, such as neutrophilic asthma or allergic asthma. Treatment with *Erysipelatoclostridium* strains may reduce recruitment of neutrophils and eosinophils into the lungs, which can help treat or prevent asthma. In certain embodiments, the composition is for use in a method of treating or preventing neutrophilic asthma or eosinophilic asthma. The compositions of the invention may be particularly effective for treating or preventing neutrophilic asthma and eosinophilic asthma. Indeed, in certain embodiments, the composition is for use in a method of reducing a neutrophilic inflammatory response in the treatment or prevention of asthma, or the composition is for use in a method of reducing an eosinophilic inflammatory response in the treatment or prevention of asthma. In preferred embodiments, the invention provides a composition comprising a bacterial strain of the species *Erysipelatoclostridium ramosum* for use in the treatment of asthma, and in particular eosinophilic or allergic asthma. Also, *Erysipelatoclostridium ramosum* may have a particularly pronounced effect on neutrophils in asthma models and treatment with *Erysipelatoclostridium ramosum* may be particularly effective for treating neutrophilic asthma.

In further preferred embodiments, the invention provides a composition comprising a bacterial strain of the genus *Erysipelatoclostridium*, for use in a method of treating or preventing rheumatoid arthritis. Treatment with *Erysipelatoclostridium* strains may provide clinical benefits in a mouse model of rheumatoid arthritis and reduce joint swelling. In preferred embodiments, the invention provides a composition comprising a bacterial strain of the species *Erysipelatoclostridium ramosum*, for use in the treatment of rheumatoid arthritis. Compositions using *Erysipelatoclostridium ramosum* may be particularly effective for treating rheumatoid arthritis.

In further preferred embodiments, the invention provides a composition comprising a bacterial strain of the genus *Erysipelatoclostridium*, for use in a method of treating or preventing multiple sclerosis. Treatment with *Erysipelatoclostridium* strains may reduce disease incidence and disease severity in a mouse model of multiple sclerosis. In preferred embodiments, the invention provides a composition comprising a bacterial strain of the species *Erysipelatoclostridium ramosum*, for use in the treatment of multiple sclerosis. Compositions using *Erysipelatoclostridium ramosum* may be particularly effective for treating multiple sclerosis.

In further preferred embodiments, the invention provides a composition comprising a bacterial strain of the genus *Erysipelatoclostridium*, for use in a method of treating or preventing cancer, such as breast, lung or liver cancer. Compositions comprising a bacterial strain of the genus *Erysipelatoclostridium* may reduce tumor growth in mouse models of breast, lung and liver cancer. In certain embodiments, the composition is for use in a method of reducing tumor size or preventing tumor growth in the treatment of cancer. In certain embodiments, the invention provides a composition comprising a bacterial strain of the species *Erysipelatoclostridium ramosum*, for use in the treatment of cancer.

In certain embodiments, the compositions of the invention are for use in a method of reducing IL-17 production or reducing Th17 cell differentiation in the treatment or prevention of a disease or condition mediated by IL-17 or the Th17 pathway. In particular, the compositions of the invention may be used in reducing IL-17 production or reducing Th17 cell differentiation in the treatment or prevention of asthma, rheumatoid arthritis, multiple sclerosis, uveitis or cancer. Preferably, the invention provides compositions comprising a bacterial strain of the genus *Erysipelatoclostridium ramosum*, for use in reducing IL-17 production or reducing Th17 cell differentiation in the treatment or prevention of asthma, rheumatoid arthritis, multiple sclerosis, uveitis or cancer.

In certain embodiments, the composition is for use in a subject with elevated IL-17 levels or Th17 cells. The effect shown for *Erysipelatoclostridium* strains on uveitis, which is strongly associated with the Th17 inflammatory response, means that *Erysipelatoclostridium* strains may be particularly beneficial for such subjects.

In preferred embodiments of the invention, the bacterial strain in the composition is of *Erysipelatoclostridium ramosum*. Closely related strains may also be used, such as bacterial strains that have a 16s rRNA sequence that is at least 95%, 96%, 97%, 98%, 99%, 99.5% or 99.9% identical to the 16s rRNA sequence of a bacterial strain of *Erysipelatoclostridium ramosum*. Preferably, the bacterial strain has a 16s rRNA sequence that is at least 95%, 96%, 97%, 98%, 99%, 99.5% or 99.9% identical to SEQ ID NO:1, 2 or 3. Preferably, the sequence identity is to SEQ ID NO:3. Preferably, the bacterial strain for use in the invention has the 16s rRNA sequence represented by SEQ ID NO:3.

In certain embodiments, the composition can comprise a *Erysipelatoclostridium* species such as *Erysipelatoclostridium ramosum*, (*Clostridium*) *cocleatum*, (*C.*) *saccharogumia*, (*C.*) *spiroforme*, or (*C.*) *innocuum*.

In certain embodiments, the composition of the invention is for oral administration. Oral administration of the strains of the invention can be effective for treating IL-17- or Th17 pathway-mediated diseases and conditions. Also, oral administration is convenient for patients and practitioners and allows delivery to and/or at least partial or total colonization of the intestine.

In certain embodiments, the composition of the invention comprises one or more pharmaceutically acceptable excipients, diluents, or carriers.

In certain embodiments, the composition of the invention comprises a bacterial strain that has been lyophilized. Lyophilization is an effective and convenient technique for preparing stable compositions that allow delivery of bacteria.

In certain embodiments, the composition comprises a bacterial strain that has been lyophilized; and further comprises a pharmaceutically acceptable excipient, diluent, or carrier.

In certain embodiments, the composition comprises a lyoprotectant, which can be a pharmaceutically acceptable excipient, diluent, or carrier.

In certain embodiments, the composition is a lyophilized composition which can be reconstituted prior to administration to a subject.

In certain embodiments, the invention provides a food product comprising the composition as described above.

In certain embodiments, the invention provides a vaccine composition comprising the composition as described above.

Additionally, the invention provides a method of treating or preventing a disease or condition mediated by IL-17 or the Th17 pathway, comprising administering a composition comprising a bacterial strain of the genus *Erysipelatoclostridium*.

In developing the above invention, the inventors have identified and characterized a bacterial strain that is particularly useful for therapy. The *Erysipelatoclostridium ramosum* strain of the invention is shown to be effective for treating the diseases described herein, such as uveitis. Therefore, in another aspect, the invention provides a cell of the *Erysipelatoclostridium ramosum* strain MRX027 (in particular MRX027 deposited as NCIMB 42688), or a derivative thereof. The invention also provides compositions comprising such cells, or biologically pure cultures of such cells. The invention also provides a cell of *Erysipelatoclostridium ramosum* strain MRX027 (in particular MRX027 deposited as NCIMB 42688), or a derivative thereof, for use in therapy, in particular for the diseases described herein.

INCORPORATION BY REFERENCE

All publications, patents, and patent applications mentioned in this specification are herein incorporated by reference in their entirety for all purposes, to the same extent as if each individual publication, patent, or patent application was specifically and individually indicated to be incorporated by reference.

DETAILED DESCRIPTION

Bacterial Strains

Figure 1:
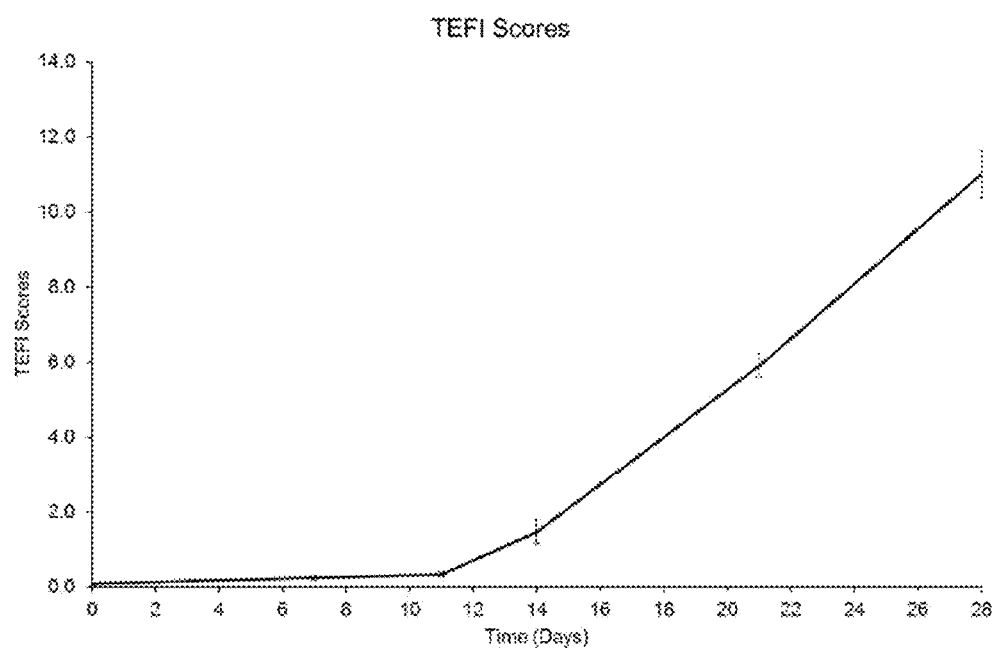
FIG. 1: Mouse model of uveitis—TEFI Scores in the control group. Data are presented as Mean±SEM.

The compositions of the invention comprise a bacterial strain of the genus *Erysipelatoclostridium*. The examples demonstrate that bacteria of this genus are useful for treating or preventing uveitis and diseases and conditions mediated by IL-17 or the Th17 pathway. The preferred bacterial strains are of the species *Erysipelatoclostridium ramosum*.

The invention provides an *Erysipelatoclostridium*, for example, an *Erysipelatoclostridium ramosum* for use in therapy, for example, for use in treating or preventing an inflammatory and/or autoimmune disease. Similarly, the invention provides a composition comprising a bacterial strain of the genus *Erysipelatoclostridium*, for example, an *Erysipelatoclostridium ramosum*, for use in therapy, for example, for use in treating or preventing an inflammatory and/or autoimmune disease. In certain embodiments, the compositions of the invention comprise *Erysipelatoclostridium*, for example, an *Erysipelatoclostridium ramosum*, and do not contain any other bacterial genus. In certain embodiments, the compositions of the invention comprise a single species of *Erysipelatoclostridium*, for example, an *Erysipelatoclostridium ramosum*, and do not contain any other bacterial species. In certain embodiments, the compositions of the invention comprise a single strain of *Erysipelatoclostridium*, for example, of *Erysipelatoclostridium ramosum*, and do not contain any other bacterial strains or species.

Examples of *Erysipelatoclostridium* species for use in the invention include *Erysipelatoclostridium ramosum*, (*Clostridium*) *cocleatum*, (*C.*) *saccharogumia*, (*C.*) *spiroforme*, and (*C.*) *innocuum* (recently reclassified in [18]). *Erysipelatoclostridium* are gram-positively staining, non-motile, obligately anaerobic straight or helically curved rods of 0.3-1.0 µm×2-4 µm. Spore formation is rare or absent. Accordingly, in some embodiments of the invention, the *Erysipelatoclostridium* bacterial strain is not in sporulated form or if any spores are present they are present in a de minimis amount. The G+C content of the genomic DNA is 27-33 mol %. They ferment glucose, fructose and sucrose [18]. The type strain of *Erysipelatoclostridium ramosum* is ATCC 25582=DSM 1402. The GenBank accession number for the 16S rRNA gene sequence of *Erysipelatoclostridium ramosum* strain DSM 1402 is X73440 (disclosed herein as SEQ ID NO:1). Exemplary *Erysipelatoclostridium ramosum* strains are described in [18]. Another strain for use in the invention is *Erysipelatoclostridium ramosum* strain JCM 1298. The GenBank accession number for the 16S rRNA gene sequence of *Erysipelatoclostridium ramosum* strain JCM 1298 is NR_113243.1 (disclosed herein as SEQ ID NO:2).

All microorganism deposits were made under the terms of the Budapest Treaty. Maintenance of a viable culture is assured for 30 years from the date of deposit. All restrictions on the availability to the public of the deposited microorganisms will be irrevocably removed upon the granting of a patent for this application. The *Erysipelatoclostridium ramosum* bacterium tested in the Examples is referred to herein as strain MRX027. A 16S rRNA sequence for the MRX027 strain that was tested is provided in SEQ ID NO:3. Strain MRX027 was deposited with the international depositary authority NCIMB, Ltd. (Ferguson Building, Aberdeen, AB21 9YA, Scotland) by 4D Pharma Research Ltd. (Life Sciences Innovation Building, Aberdeen, AB25 2ZS, Scotland) on 15 Nov. 2016 and was assigned accession number NCIMB 42688. The terms "MRX027" and "MRx0027" are used interchangeably herein.

Bacterial strains closely related to the strain tested in the examples are also expected to be effective for treating or preventing uveitis and diseases and conditions mediated by IL-17 or the Th17 pathway. In certain embodiments, the bacterial strain for use in the invention has a 16s rRNA sequence that is at least 95%, 96%, 97%, 98%, 99%, 99.5% or 99.9% identical to the 16s rRNA sequence of a bacterial strain of *Erysipelatoclostridium ramosum*. Preferably, the bacterial strain for use in the invention has a 16s rRNA sequence that is at least 95%, 96%, 97%, 98%, 99%, 99.5% or 99.9% identical to SEQ ID NO:1, 2 or 3. Preferably, the sequence identity is to SEQ ID NO:3. Preferably, the bacterial strain for use in the invention has the 16s rRNA sequence represented by SEQ ID NO:3.

Bacterial strains that are biotypes of strains MRX027 (in particular MRX027 deposited as NCIMB 42688), ATCC 25582 and JCM 1298 are also expected to be effective for treating or preventing uveitis and diseases and conditions mediated by IL-17 or the Th17 pathway. A biotype is a closely related strain that has the same or very similar physiological and biochemical characteristics.

Strains that are biotypes of strains MRX027 (in particular MRX027 deposited as NCIMB 42688), ATCC 25582 or JCM 1298 and that are suitable for use in the invention may be identified by sequencing other nucleotide sequences for strains MRX027 (in particular MRX027 deposited as NCIMB 42688), ATCC 25582 or JCM 1298. For example, substantially the whole genome may be sequenced and a biotype strain for use in the invention may have at least 95%, 96%, 97%, 98%, 99%, 99.5% or 99.9% sequence identity across at least 80% of its whole genome (e.g. across at least 85%, 90%, 95% or 99%, or across its whole genome). For example, in some embodiments, a biotype strain has at least 98% sequence identity across at least 98% of its genome or at least 99% sequence identity across 99% of its genome. Other suitable sequences for use in identifying biotype strains may include hsp60 or repetitive sequences such as BOX, ERIC, $(GTG)_5$ (SEQ ID NO: 5), or REP or [19]. Biotype strains may have sequences with at least 95%, 96%, 97%, 98%, 99%, 99.5% or 99.9% sequence identity to the corresponding sequence of strains MRX027 (in particular MRX027 deposited as NCIMB 42688), ATCC 25582 or JCM 1298. In some embodiments, a biotype strain has a sequence with at least 95%, 96%, 97%, 98%, 99%, 99.5% or 99.9% sequence identity to the corresponding sequence of strain MRX027 deposited as NCIMB 42688 and comprises a 16S rRNA sequence that is at least 99% identical (e.g. at least 99.5% or at least 99.9% identical) to SEQ ID NO:3. In some embodiments, a biotype strain has a sequence with at least 95%, 96%, 97%, 98%, 99%, 99.5% or 99.9% sequence identity to the corresponding sequence of strain MRX027 deposited as NCIMB 42688 and has the 16S rRNA sequence of SEQ ID NO:3.

Alternatively, strains that are biotypes of strains MRX027 (in particular MRX027 deposited as NCIMB 42688), ATCC 25582 or JCM 1298 and that are suitable for use in the invention may be identified by using strain strains MRX027 (in particular MRX027 deposited as NCIMB 42688), ATCC 25582 or JCM 1298 and restriction fragment analysis and/or PCR analysis, for example by using fluorescent amplified fragment length polymorphism (FAFLP) and repetitive DNA element (rep)-PCR fingerprinting, or protein profiling, or partial 16S or 23s rDNA sequencing. In preferred embodiments, such techniques may be used to identify other *Erysipelatoclostridium ramosum* strains.

In certain embodiments, strains that are biotypes of strains MRX027 (in particular MRX027 deposited as NCIMB 42688), ATCC 25582 or JCM 1298 and that are suitable for use in the invention are strains that provide the same pattern as strains MRX027 (in particular MRX027 deposited as NCIMB 42688), ATCC 25582 or JCM 1298 when analyzed by amplified ribosomal DNA restriction analysis (ARDRA), for example when using Sau3AI restriction enzyme (for exemplary methods and guidance see, for example, [20]). Alternatively, biotype strains are identified as strains that have the same carbohydrate fermentation patterns as strains MRX027 (in particular MRX027 deposited as NCIMB 42688), ATCC 25582 or JCM 1298.

Other *Erysipelatoclostridium ramosum* strains that are useful in the compositions and methods of the invention, such as biotypes of strains MRX027 (in particular MRX027 deposited as NCIMB 42688), ATCC 25582 or JCM 1298, may be identified using any appropriate method or strategy, including the assays described in the examples. For instance, strains for use in the invention may be identified by culturing in anaerobic YCFA and/or administering the bacteria to the type II collagen-induced arthritis mouse model and then assessing cytokine levels. In particular, bacterial strains that have similar growth patterns, metabolic type and/or surface antigens to strains MRX027 (in particular MRX027 deposited as NCIMB 42688), ATCC 25582 or JCM 1298 may be useful in the invention. A useful strain will have comparable immune modulatory activity to strains MRX027 (in particular MRX027 deposited as NCIMB 42688), ATCC 25582 or JCM 1298. In particular, a biotype strain will elicit comparable effects on the uveitis disease models to the effects shown in the Examples, which may be identified by using the culturing and administration protocols described in the Examples.

A particularly preferred strain of the invention is strain MRX027 strain (in particular MRX027 deposited as NCIMB 42688). This is the exemplary strain tested in the examples and shown to be effective for treating disease. Therefore, the invention provides a cell, such as an isolated cell, of *Erysipelatoclostridium ramosum* strain MRX027 (in particular MRX027 deposited as NCIMB 42688), or a derivative thereof. The invention also provides a composition comprising a cell of *Erysipelatoclostridium ramosum* strain MRX027 (in particular MRX027 deposited as NCIMB 42688), or a derivative thereof. The invention also provides a biologically pure culture of *Erysipelatoclostridium ramosum* strain MRX027 (in particular MRX027 deposited as NCIMB 42688). The invention also provides a cell of *Erysipelatoclostridium ramosum* strain MRX027 (in particular MRX027 deposited as NCIMB 42688), or a derivative thereof, for use in therapy, in particular for the diseases described herein. A derivative of *Erysipelatoclostridium ramosum* strain MRX027 (in particular MRX027 deposited as NCIMB 42688) may be a daughter strain (progeny) or a strain cultured (subcloned) from the original.

A derivative of a strain of the invention may be modified, for example at the genetic level, without ablating the biological activity. In particular, a derivative strain of the invention is therapeutically active. A derivative strain will have comparable immune modulatory activity to the *Erysipelatoclostridium ramosum* strain MRX027 (in particular MRX027 deposited as NCIMB 42688). In particular, a derivative strain will elicit comparable effects on the uveitis disease models to the effects shown in the Examples, which may be identified by using the culturing and administration protocols described in the Examples. A derivative of strain MRX027 (in particular MRX027 deposited as NCIMB 42688) will generally be a biotype of strain MRX027 (in particular MRX027 deposited as NCIMB 42688).

References to cells of *Erysipelatoclostridium ramosum* strain MRX027 encompass any cells that have the same safety and therapeutic efficacy characteristics as strain MRX027, and such cells are encompassed by the invention. Reference to MRX027 deposited as NCIMB 42688 refers to the deposited MRX027 strain only.

The genome sequence of *Erysipelatoclostridium ramosum* strain DSM 1402 is disclosed herein as SEQ ID NO:4. This sequence is a genomic scaffold obtained using whole genome shotgun sequencing and is also available using GenBank accession number NZ_DS499659.1. In certain embodiments, the bacterial strain for use in the invention has a chromosome with sequence identity to SEQ ID NO:4. In some embodiments, the bacterial strain for use in the invention has a chromosome with at least 90% sequence identity (e.g. at least 92%, 94%, 95%, 96%, 97%, 98%, 99% or 100% sequence identity) to SEQ ID NO:4 across at least 30% (e.g. across at least 35%, 40%, 45%, 50%, 55%, 60%, 65%, 70%, 75%, 80%, 85%, 95%, 96%, 97%, 98%, 99% or 100%) of SEQ ID NO:4. For example, the bacterial strain for use in the invention may have a chromosome with at least 95% sequence identity to SEQ ID NO:4 across 35% of SEQ ID NO:4, or at least 95% sequence identity to SEQ ID NO:4 across 45% of SEQ ID NO:4, or at least 90% sequence identity to SEQ ID NO:4 across 70% of SEQ ID NO:4, or at least 90% sequence identity to SEQ ID NO:4 across 80% of SEQ ID NO:4, or at least 90% sequence identity to SEQ ID NO:4 across 90% of SEQ ID NO:4, or at least 90% sequence identity to SEQ ID NO:4 across 100% of SEQ ID NO:4, or at least 95% sequence identity to SEQ ID NO:4 across 70% of SEQ ID NO:4, or at least 95% sequence identity to SEQ ID NO:4 across 80% of SEQ ID NO:4, or at least 95% sequence identity to SEQ ID NO:4 across 90% of SEQ ID NO:4, or at least 95% sequence identity to SEQ ID NO:4 across 100% of SEQ ID NO:4, or at least 98% sequence identity to SEQ ID NO:4 across 70% of SEQ ID NO:4, or at least 98% sequence identity to SEQ ID NO:4 across 80% of SEQ ID NO:4, or at least 98% sequence identity to SEQ ID NO:4 across 90% of SEQ ID NO:4, or at least 98% identity across 95% of SEQ ID NO:4, or at least 98% sequence identity to SEQ ID NO:4 across 100% of SEQ ID NO:4, or at least 99.5% sequence identity to SEQ ID NO:4 across 90% of SEQ ID NO:4, or at least 99.5% identity across 95% of SEQ ID NO:4, or at least 99.5% identity across 98% of SEQ ID NO:4, or at least 99.5% sequence identity to SEQ ID NO:4 across 100% of SEQ ID NO:4.

In certain embodiments, the bacterial strain for use in the invention has a chromosome with sequence identity to SEQ ID NO:4 in the region flanking the 16S rRNA sequence. In some embodiments, the bacterial strain for use in the invention has a chromosome with at least 95% (e.g. at least 96%, 97%, 98%, 99%, 99.5% or 100%) sequence identity to the 0.5 kb sequence directly upstream and/or downstream of the 16S rRNA sequence in SEQ ID NO:4. In some embodiments, the bacterial strain for use in the invention has a chromosome with at least 95% (e.g. at least 96%, 97%, 98%, 99%, 99.5% or 100%) sequence identity to the 1 kb sequence directly upstream and/or downstream of the 16S rRNA sequence in SEQ ID NO:4. In some embodiments, the bacterial strain for use in the invention has a chromosome with at least 95% (e.g. at least 96%, 97%, 98%, 99%, 99.5% or 100%) sequence identity to the 1.5 kb sequence directly upstream and/or downstream of the 16S rRNA sequence in SEQ ID NO:4. In some embodiments, the bacterial strain for use in the invention has a chromosome with at least 95% (e.g. at least 96%, 97%, 98%, 99%, 99.5% or 100%) sequence identity to the 2 kb sequence directly upstream and/or downstream of the 16S rRNA sequence in SEQ ID NO:4.

In certain embodiments, the bacterial strain for use in the invention has a chromosome with sequence identity to SEQ ID NO:4, for example as described above, and a 16S rRNA sequence with sequence identity to any of SEQ ID NO:1, 2 or 3, for example as described above, preferably with a 16s rRNA sequence that is at least 99% identical to SEQ ID NO:3, more preferably which comprises the 16S rRNA sequence of SEQ ID NO:3.

In certain embodiments, the bacterial strain for use in the invention has a chromosome with sequence identity to SEQ ID NO:4, for example as described above, and is effective for treating or preventing diseases and conditions mediated by IL-17 or the Th17 pathway.

In certain embodiments, the bacterial strain for use in the invention has a chromosome with sequence identity to SEQ ID NO:4, for example as described above, and a 16S rRNA sequence with sequence identity to any of SEQ ID NOs: 1, 2 or 3, for example as described above, and is effective for treating or preventing diseases and conditions mediated by IL-17 or the Th17 pathway.

In certain embodiments, the bacterial strain for use in the invention has a 16s rRNA sequence that is at least 99%, 99.5% or 99.9% identical to the 16s rRNA sequence represented by SEQ ID NO: 3 (for example, which comprises the 16S rRNA sequence of SEQ ID NO:3) and a chromosome with at least 95% sequence identity to SEQ ID NO:4 across at least 40% of SEQ ID NO:4, and which is effective for treating or preventing diseases and conditions mediated by IL-17 or the Th17 pathway.

In certain embodiments, the bacterial strain for use in the invention has a 16s rRNA sequence that is at least 99%, 99.5% or 99.9% identical to the 16s rRNA sequence represented by SEQ ID NO: 3 (for example, which comprises the 16S rRNA sequence of SEQ ID NO:3) and a chromosome with at least 95% sequence identity to SEQ ID NO:4 across at least 90% of SEQ ID NO:4, and which is effective for treating or preventing diseases and conditions mediated by IL-17 or the Th17 pathway.

In certain embodiments, the bacterial strain for use in the invention is a *Erysipelatoclostridium ramosum* and has a 16s rRNA sequence that is at least 99%, 99.5% or 99.9% identical to the 16s rRNA sequence represented by SEQ ID NO: 3 (for example, which comprises the 16S rRNA sequence of SEQ ID NO:3) and a chromosome with at least 98% sequence identity (e.g. at least 99% or at least 99.5% sequence identity) to SEQ ID NO:4 across at least 98% (e.g. across at least 99% or at least 99.5%) of SEQ ID NO:4, and which is effective for treating or preventing diseases and conditions mediated by IL-17 or the Th17 pathway.

In preferred embodiments, the bacterial strains in the compositions of the invention are viable and capable of at least partially or totally colonizing the intestine.

Therapeutic Uses

As demonstrated in the examples, the bacterial compositions of the invention are effective for reducing the Th17 inflammatory response. In particular, treatment with compositions of the invention achieves clinical improvements in animal models of conditions mediated by IL-17 and the Th17 pathway and may achieve a reduction in IL-17A levels and other Th17 pathway cytokines. Therefore, the compositions of the invention may be useful for treating or preventing inflammatory and autoimmune diseases, and in particular diseases or conditions mediated by IL-17. In particular, the compositions of the invention may be useful for reducing or preventing elevation of the IL-17 inflammatory response.

Th17 cells are a subset of T helper cells that produce, for example, IL-17A, IL17-F, IL-21 and IL-22. Th17 cell differentiation and IL-17 expression may be driven by IL-23. These cytokines and others form important parts of the Th17 pathway, which is a well-established inflammatory signaling pathway that contributes to and underlies a number of inflammatory and autoimmune diseases (as described in, for example, [21-26]). Diseases wherein the Th17 pathway is activated are Th17 pathway-mediated diseases. Th17 pathway-mediated diseases can be ameliorated or alleviated by repressing the Th17 pathway, which may be through a reduction in the differentiation of Th17 cells or a reduction in their activity or a reduction in the level of Th17 pathway cytokines. Diseases mediated by the Th17 pathway may be characterized by increased levels of cytokines produced by Th17 cells, such as IL-17A, IL-17F, IL-21, IL-22, IL-26, IL-9 (reviewed in [27]). Diseases mediated by the Th17 pathway may be characterized by increased expression of Th-17-related genes, such as Stat3 or IL-23R. Diseases mediated by the Th17 pathway may be associated with increased levels of Th17 cells.

IL-17 is a pro-inflammatory cytokine that contributes to the pathogenesis of several inflammatory and autoimmune diseases and conditions. IL-17 as used herein may refer to any member of the IL-17 family, including IL-17A, IL-17B, IL-17C, IL-17D, IL-17E, and IL-17F. IL-17-mediated diseases and conditions are characterized by high expression of IL-17 and/or the accumulation or presence of IL-17-positive cells in a tissue affected by the disease or condition. Similarly, IL-17-mediated diseases and conditions are diseases and conditions that are exacerbated by high IL-17 levels or an increase in IL-17 levels, and that are alleviated by low IL-17 levels or a reduction in IL-17 levels. The IL-17 inflammatory response may be local or systemic.

Examples of diseases and conditions that may be mediated by IL-17 or the Th17 pathway include uveitis; cancer, such as breast cancer, lung cancer, liver cancer, colon cancer, or ovarian cancer; multiple sclerosis; arthritis, such as rheumatoid arthritis, osteoarthritis, psoriatic arthritis, or juvenile idiopathic arthritis; neuromyelitis optica (Devic's disease); ankylosing spondylitis; spondyloarthritis; psoriasis; systemic lupus erythematosus; inflammatory bowel disease, such as Crohn's disease or ulcerative colitis; celiac disease; asthma, such as allergic asthma or neutrophilic asthma; chronic obstructive pulmonary disease (COPD); scleritis; vasculitis; Behcet's disease; atherosclerosis; atopic dermatitis; emphysema; periodontitis; allergic rhinitis; and allograft rejection. In preferred embodiments, the compositions of the invention are used for treating or preventing one or more of these conditions or diseases. In further preferred embodiments, these conditions or diseases are mediated by IL-17 or the Th17 pathway.

In some embodiments, the pathogenesis of the disease or condition affects the intestine. In some embodiments, the pathogenesis of the disease or condition does not affect the intestine. In some embodiments, the pathogenesis of the disease or condition is not localized at the intestine. In some embodiments, the treating or preventing occurs at a site other than at the intestine. In some embodiments, the treating or preventing occurs at the intestine and also at a site other than at the intestine. In certain embodiments, the disease or condition is systemic.

In certain embodiments, the compositions of the invention are for use in a method of reducing IL-17 production or reducing Th17 cell differentiation in the treatment or prevention of a disease or condition mediated by IL-17 or the Th17 pathway. In certain embodiments, the compositions of the invention are for use in treating or preventing an inflammatory or autoimmune disease, wherein said treatment or prevention is achieved by reducing or preventing elevation of the Th17 inflammatory response. In certain embodiments, the compositions of the invention are for use in treating a subject with an inflammatory or autoimmune disease, wherein the subject has elevated IL-17 levels or elevated Th17 cells or is exhibiting a Th17 inflammatory response. In certain embodiments, the subject may have been diagnosed with a chronic inflammatory or autoimmune disease or condition, or the composition of the invention may be for use in preventing an inflammatory or autoimmune disease or condition developing into a chronic inflammatory or autoimmune disease or condition. In certain embodiments, the disease or condition may not be responsive to treatment with TNF-α inhibitors. These uses of the invention may be applied to any of the specific disease or conditions listed in the preceding paragraph.

IL-17 and the Th17 pathway are often associated with chronic inflammatory and autoimmune diseases, so the compositions of the invention may be particularly useful for treating or preventing chronic diseases or conditions as listed above. In certain embodiments, the compositions are for use in subjects with chronic disease. In certain embodiments, the compositions are for use in preventing the development of chronic disease.

The compositions of the invention may be useful for treating diseases and conditions mediated by IL-17 or the Th17 pathway and for addressing the Th17 inflammatory response, so the compositions of the invention may be particularly useful for treating or preventing chronic disease, treating or preventing disease in subjects that have not responded to other therapies (such as treatment with TNF-α inhibitors), and/or treating or preventing the tissue damage and symptoms associated with IL-17 and Th17 cells. For example, IL-17 is known to activate matrix destruction in cartilage and bone tissue and IL-17 has an inhibitory effect on matrix production in chondrocytes and osteoblasts, so the compositions of the invention may be useful for treating or preventing bone erosion or cartilage damage.

In certain embodiments, treatment with compositions of the invention provides a reduction or prevents an elevation in IL-17 levels, in particular IL-17A levels. In certain embodiments, treatment with compositions of the invention provides a reduction or prevents an elevation in TNFα, IFN-γ or IL-6 levels. Such reduction or prevention of elevated levels of these cytokines may be useful for treating or preventing inflammatory and autoimmune diseases and conditions, in particular those mediated by IL-17 or the Th17 pathway.

Uveitis

In preferred embodiments, the compositions of the invention are for use in treating or preventing uveitis. The examples demonstrate that the compositions of the invention achieve a reduction in disease incidence and disease severity in an animal model of uveitis and so they may be useful in the treatment or prevention of uveitis. Uveitis is inflammation of the uvea and can result in retinal tissue destruction. It can present in different anatomical forms (anterior, intermediate, posterior or diffuse) and result from different, but related, causes, including systemic autoimmune disorders. IL-17 and the Th17 pathway are centrally involved in uveitis, so the efficacy of the compositions of the invention for treating uveitis indicates that the compositions of the invention may be particularly effective for treating and preventing diseases and conditions mediated by IL-17 or the Th17 pathway. References [28-35] describe elevated serum levels of interleukin-17A in subjects with uveitis, specific association of IL17A genetic variants with panuveitis, the role of Th17-associated cytokines in the pathogenesis of experimental autoimmune uveitis, the imbalance between Th17 Cells and regulatory T Cells during monophasic experimental autoimmune uveitis, the up-regulation of IL-17A in subjects with uveitis and active Adamantiades-Behcet and Vogt-Koyanagi-Harada (VKH) diseases, the treatment of non-infectious uveitis with secukinumab (anti-IL-17A antibody), and Th17 in uveitic eyes.

In certain embodiments, the uveitis is posterior uveitis. Posterior uveitis presents primarily with inflammation of the retina and choroid and the examples demonstrate that the compositions of the invention are effective for reducing retinal inflammation and damage.

In certain embodiments, treatment with the compositions of the invention results in a reduction in retinal damage. In certain embodiments, the compositions of the invention are for use in reducing or preventing retinal damage in the treatment of uveitis. In certain embodiments, the compositions are for use in treating subjects with severe uveitis that are at risk of retinal damage. In certain embodiments, treatment with the compositions of the invention results in a reduction in optic disc inflammation. In certain embodiments, the compositions of the invention are for use in reducing or preventing optic disc inflammation. In certain embodiments, treatment with the compositions of the invention results in a reduction in retinal tissue infiltration by inflammatory cells. In certain embodiments, the compositions of the invention are for use in reducing retinal tissue infiltration by inflammatory cells. In certain embodiments, treatment with the compositions of the invention results in vision being maintained or improved. In certain embodiments, the compositions of the invention are for use in maintaining or improving vision.

In certain embodiments, the compositions are for use in treating or preventing uveitis associated with a non-infectious or autoimmune disease, such as Behcet disease, Crohn's disease, Fuchs heterochromic iridocyclitis, granulomatosis with polyangiitis, HLA-B27 related uveitis, juvenile idiopathic arthritis, sarcoidosis, spondyloarthritis, sympathetic ophthalmia, tubulointerstitial nephritis and uveitis syndrome or Vogt-Koyanagi-Harada syndrome. IL-17A has been shown to be involved in, for example, Behcet and Vogt-Koyanagi-Harada diseases. Treatment or prevention of uveitis may refer to, for example, an alleviation of the severity of symptoms or a prevention of relapse.

Cancer

In preferred embodiments, the compositions of the invention are for use in treating or preventing cancer. IL-17 and the Th17 pathway have central roles in cancer development and progression, and so the compositions of the invention may be useful for treating or preventing cancer.

Although the roles of IL-17 and Th17 cells in cancer are not fully understood, numerous pro-tumor effects of IL-17 and Th17 cells are known. For example, Th17 cells and IL-17 can promote angiogenesis, increase proliferation and survival of tumor cells and activate tumor-promoting transcription factors [36-38].

In certain embodiments, treatment with the compositions of the invention results in a reduction in tumor size or a reduction in tumor growth. In certain embodiments, the compositions of the invention are for use in reducing tumor size or reducing tumor growth. The compositions of the invention may be effective for reducing tumor size or growth. In certain embodiments, the compositions of the invention are for use in subjects with solid tumors. In certain embodiments, the compositions of the invention are for use in reducing or preventing angiogenesis in the treatment of cancer. IL-17 and Th17 cells have central roles in angiogenesis. In certain embodiments, the compositions of the invention are for use in preventing metastasis.

In certain embodiments, the compositions of the invention are for use in treating or preventing breast cancer. The compositions of the invention may be effective for treating breast cancer, and IL-17 and Th17 cells have important roles in breast cancer [39]. In certain embodiments, the compositions of the invention are for use in reducing tumor size, reducing tumor growth, or reducing angiogenesis in the treatment of breast cancer. In preferred embodiments the cancer is mammary carcinoma. In preferred embodiments the cancer is stage IV breast cancer.

In certain embodiments, the compositions of the invention are for use in treating or preventing lung cancer. The compositions of the invention may be effective for treating lung cancer, and IL-17 and Th17 cells have important roles in lung cancer [40]. In certain embodiments, the compositions of the invention are for use in reducing tumor size, reducing tumor growth, or reducing angiogenesis in the treatment of lung cancer. In preferred embodiments the cancer is lung carcinoma.

In certain embodiments, the compositions of the invention are for use in treating or preventing liver cancer. The compositions of the invention may be effective for treating liver cancer, and IL-17 and Th17 cells have important roles in liver cancer [41]. In certain embodiments, the compositions of the invention are for use in reducing tumor size, reducing tumor growth, or reducing angiogenesis in the treatment of liver cancer. In preferred embodiments the cancer is hepatoma (hepatocellular carcinoma).

In certain embodiments, the compositions of the invention are for use in treating or preventing carcinoma. The compositions of the invention may be particularly effective for treating carcinoma. In certain embodiments, the compositions of the invention are for use in treating or preventing non-immunogenic cancer. The compositions of the invention may be effective for treating non-immunogenic cancers.

In further embodiments, the compositions of the invention are for use in treating or preventing acute lymphoblastic leukemia (ALL), acute myeloid leukemia, adrenocortical carcinoma, basal-cell carcinoma, bile duct cancer, bladder cancer, bone tumor, osteosarcoma/malignant fibrous histiocytoma, brainstem glioma, brain tumor, cerebellar astrocytoma, cerebral astrocytoma/malignant glioma, ependymoma, medulloblastoma, supratentorial primitive neuroectodermal tumors, breast cancer, bronchial adenomas/carcinoids, Burkitt's lymphoma, carcinoid tumor, cervical cancer, chronic lymphocytic leukemia, chronic myelogenous leukemia, chronic myeloproliferative disorders, colon cancer, cutaneous T-cell lymphoma, endometrial cancer, ependymoma, esophageal cancer, Ewing's sarcoma, intraocular melanoma, retinoblastoma, gallbladder cancer, gastric cancer, gastrointestinal carcinoid tumor, gastrointestinal stromal tumor (GIST), germ cell tumor, glioma, childhood visual pathway and hypothalamic, Hodgkin lymphoma, melanoma, islet cell carcinoma, Kaposi sarcoma, renal cell cancer, laryngeal cancer, leukaemias, lymphomas, mesothelioma, neuroblastoma, non-Hodgkin lymphoma, oropharyngeal cancer, osteosarcoma, ovarian cancer, pancreatic cancer, parathyroid cancer, pharyngeal cancer, pituitary adenoma, plasma cell neoplasia, prostate cancer, renal cell carcinoma, retinoblastoma, sarcoma, testicular cancer, thyroid cancer, or uterine cancer.

The compositions of the invention may be particularly effective when used in combination with further therapeutic agents. The immune-modulatory effects of the compositions of the invention may be effective when combined with more direct anti-cancer agents. Therefore, in certain embodiments, the invention provides a composition comprising a bacterial strain of the genus *Erysipelatoclostridium* and an anticancer agent. In preferred embodiments the anticancer agent is an immune checkpoint inhibitor, a targeted antibody immunotherapy, a CAR-T cell therapy, an oncolytic virus, or a cytostatic drug. In preferred embodiments, the composition comprises an anti-cancer agent selected from the group consisting of: Yervoy (ipilimumab, BMS); Keytruda (pembrolizumab, Merck); Opdivo (nivolumab, BMS); MEDI4736 (AZ/MedImmune); MPDL3280A (Roche/Genentech); Tremelimumab (AZ/MedImmune); CT-011 (pidilizumab, CureTech); BMS-986015 (lirilumab, BMS); MEDI0680 (AZ/MedImmune); MSB-0010718C (Merck); PF-05082566 (Pfizer); MEDI6469 (AZ/MedImmune); BMS-986016 (BMS); BMS-663513 (urelumab, BMS); IMP321 (Prima Biomed); LAG525 (Novartis); ARGX-110 (arGEN-X); PF-05082466 (Pfizer); CDX-1127 (varlilumab; CellDex Therapeutics); TRX-518 (GITR Inc.); MK-4166 (Merck); JTX-2011 (Jounce Therapeutics); ARGX-115 (arGEN-X); NLG-9189 (indoximod, NewLink Genetics); INCB024360 (Incyte); IPH2201 (Innate Immotherapeutics/AZ); NLG-919 (NewLink Genetics); anti-VISTA (JnJ); Epacadostat (INCB24360, Incyte); F001287 (Flexus/BMS); CP 870893 (University of Pennsylvania); MGA271 (Macrogenix); Emactuzumab (Roche/Genentech); Galunisertib (Eli Lilly); Ulocuplumab (BMS); BKT140/BL8040 (Biokine Therapeutics); Bavituximab (Peregrine Pharmaceuticals); CC 90002 (Celgene); 852A (Pfizer); VTX-2337 (VentiRx Pharmaceuticals); IMO-2055 (Hybridon, Idera Pharmaceuticals); LY2157299 (Eli Lilly); EW-7197 (Ewha Women's University, Korea); Vemurafenib (Plexxikon); Dabrafenib (Genentech/GSK); BMS-777607 (BMS); BLZ945 (Memorial Sloan-Kettering Cancer Centre); Unituxin (dinutuximab, United Therapeutics Corporation); Blincyto (blinatumomab, Amgen); Cyramza (ramucirumab, Eli Lilly); Gazyva (obinutuzumab, Roche/Biogen); Kadcyla (ado-trastuzumab emtansine, Roche/Genentech); Perjeta (pertuzumab, Roche/Genentech); Adcetris (brentuximab vedotin, Takeda/Millennium); Arzerra (ofatumumab, GSK); Vectibix (panitumumab, Amgen); Avastin (bevacizumab, Roche/Genentech); Erbitux (cetuximab, BMS/Merck); Bexxar (tositumomab-I131, GSK); Zevalin (ibritumomab tiuxetan, Biogen); Campath (alemtuzumab, Bayer); Mylotarg (gemtuzumab ozogamicin, Pfizer); Herceptin (trastuzumab, Roche/Genentech); Rituxan (rituximab, Genentech/Biogen); volociximab (Abbvie); Enavatuzumab (Abbvie); ABT-414 (Abbvie); Elotuzumab (Abbvie/BMS); ALX-0141 (Ablynx); Ozaralizumab (Ablynx); Actimab-C (Actinium); Actimab-P (Actinium); Milatuzumab-dox (Actinium); Emab-SN-38 (Actinium); Naptumonmab estafenatox (Active Biotech); AFM13 (Affimed); AFM11 (Affimed); AGS-16C3F (Agensys); AGS-16M8F (Agensys); AGS-22ME (Agensys); AGS-15ME (Agensys); GS-67E (Agensys); ALXN6000 (samalizumab, Alexion); ALT-836 (Altor Bioscience); ALT-801 (Altor Bioscience); ALT-803 (Altor Bioscience); AMG780 (Amgen); AMG 228 (Amgen); AMG820 (Amgen); AMG172 (Amgen); AMG595 (Amgen); AMG110 (Amgen); AMG232 (adecatumumab, Amgen); AMG211 (Amgen/MedImmune); BAY20-10112 (Amgen/Bayer); Rilotumumab (Amgen); Denosumab (Amgen); AMP-514 (Amgen); MEDI575 (AZ/MedImmune); MEDI3617 (AZ/MedImmune); MEDI6383 (AZ/MedImmune); MEDI551 (AZ/MedImmune); Moxetumomab pasudotox (AZ/MedImmune); MEDI565 (AZ/MedImmune); MEDI0639 (AZ/MedImmune); MEDI0680 (AZ/MedImmune); MEDI562 (AZ/MedImmune); AV-380 (AVEO); AV203 (AVEO); AV299 (AVEO); BAY79-4620 (Bayer); Anetumab ravtansine (Bayer); vantictumab (Bayer); BAY94-9343 (Bayer); Sibrotuzumab (Boehringer Ingleheim); BI-836845 (Boehringer Ingleheim); B-701 (BioClin); BIIB015 (Biogen); Obinutuzumab (Biogen/Genentech); BI-505 (Bioinvent); BI-1206 (Bioinvent); TB-403 (Bioinvent); BT-062 (Biotest) BIL-010t (Biosceptre); MDX-1203 (BMS); MDX-1204 (BMS); Necitumumab (BMS); CAN-4 (Cantargia AB); CDX-011 (Celldex); CDX1401 (Celldex); CDX301 (Celldex); U3-1565 (Daiichi Sankyo); patritumab (Daiichi Sankyo); tigatuzumab (Daiichi Sankyo); nimotuzumab (Daiichi Sankyo); DS-8895 (Daiichi Sankyo); DS-8873 (Daiichi Sankyo); DS-5573 (Daiichi Sankyo); MORab-004 (Eisai); MORab-009 (Eisai); MORab-003 (Eisai); MORab-066 (Eisai); LY3012207 (Eli Lilly); LY2875358 (Eli Lilly); LY2812176 (Eli Lilly); LY3012217 (Eli Lilly); LY2495655 (Eli Lilly); LY3012212 (Eli Lilly); LY3012211 (Eli Lilly); LY3009806 (Eli Lilly); cixutumumab (Eli Lilly); Flanvotumab (Eli Lilly); IMC-TR1 (Eli Lilly); Ramucirumab (Eli Lilly); Tabalumab (Eli Lilly); Zanolimumab (Emergent Biosolution); FG-3019 (FibroGen); FPA008 (Five Prime Therapeutics); FP-1039 (Five Prime Therapeutics); FPA144 (Five Prime Therapeutics); catumaxomab (Fresenius Biotech); IMAB362 (Ganymed); IMAB027 (Ganymed); HuMax-CD74 (Genmab); HuMax-TFADC (Genmab); GS-5745 (Gilead); GS-6624 (Gilead); OMP-21M18 (demcizumab, GSK); mapatumumab (GSK); IMGN289 (ImmunoGen); IMGN901 (ImmunoGen); IMGN853 (ImmunoGen); IMGN529 (ImmunoGen); IMMU-130 (Immunomedics); milatuzumab-dox (Immunomedics); IMMU-115 (Immunomedics); IMMU-132 (Immunomedics); IMMU-106 (Immunomedics); IMMU-102 (Immunomedics); Epratuzumab (Immunomedics); Clivatuzumab (Immunomedics); IPH41 (Innate Immunotherapeutics); Daratumumab (Janssen/Genmab); CNTO-95 (Intetumumab, Janssen); CNTO-328 (siltuximab, Janssen); KB004 (KaloBios); mogamulizumab (Kyowa Hakko Kirrin); KW-2871 (ecromeximab, Life Science); Sonepcizumab (Lpath); Margetuximab (Macrogenics); Enoblituzumab (Macrogenics); MGD006 (Macrogenics); MGF007 (Macrogenics); MK-0646 (dalotuzumab, Merck); MK-3475 (Merck); Sym004 (Symphogen/Merck Serono); DI17E6 (Merck Serono); MOR208 (Morphosys); MOR202 (Morphosys); Xmab5574 (Morphosys); BPC-1C (ensituximab, Precision Biologics); TAS266 (Novartis); LFA102 (Novartis); BHQ880 (Novartis/Morphosys); QGE031 (Novartis); HCD122 (lucatumumab, Novartis); LJM716 (Novartis); AT355 (Novartis); OMP-21M18 (Demcizumab, OncoMed); OMP52M51 (Oncomed/GSK); OMP-59R5 (Oncomed/GSK); vantictumab (Oncomed/Bayer); CMC-544 (inotuzumab ozogamicin, Pfizer); PF-03446962 (Pfizer); PF-04856884 (Pfizer); PSMA-ADC (Progenics); REGN1400 (Regeneron); REGN910 (nesvacumab, Regeneron/Sanofi); REGN421 (enoticumab, Regeneron/Sanofi); RG7221, RG7356, RG7155, RG7444, RG7116, RG7458, RG7598, RG7599, RG7600, RG7636, RG7450, RG7593, RG7596, DCDS3410A, RG7414 (parsatuzumab), RG7160 (imgatuzumab), RG7159 (obintuzumab), RG7686, RG3638 (onartuzumab), RG7597 (Roche/Genentech); SAR307746 (Sanofi); SAR566658 (Sanofi); SAR650984 (Sanofi); SAR153192 (Sanofi); SAR3419 (Sanofi); SAR256212 (Sanofi), SGN-LIV1A (lintuzumab, Seattle Genetics); SGN-CD33A (Seattle Genetics); SGN-75 (vorsetuzumab mafodotin, Seattle Genetics); SGN-19A (Seattle Genetics) SGN-CD70A (Seattle Genetics); SEA-CD40 (Seattle Genetics); ibritumomab tiuxetan (Spectrum); MLN0264 (Takeda); ganitumab (Takeda/Amgen); CEP-37250 (Teva); TB-403 (Thrombogenic); VB4-845 (Viventia); Xmab2512 (Xencor); Xmab5574 (Xencor); nimotuzumab (YM Biosciences); Carlumab (Janssen); NY-ESO TCR (Adaptimmune); MAGE-A-10 TCR (Adaptimmune); CTL019 (Novartis); JCAR015 (Juno Therapeutics); KTE-C19 CAR (Kite Pharma); UCART19 (Cellectis); BPX-401 (Bellicum Pharmaceuticals); BPX-601 (Bellicum Pharmaceuticals); ATTCK20 (Unum Therapeutics); CAR-NKG2D (Celyad); Onyx-015 (Onyx Pharmaceuticals); H101 (Shanghai Sunwaybio); DNX-2401 (DNAtrix); VCN-01 (VCN Biosciences); Colo-Ad1 (PsiOxus Therapeutics); ProstAtak (Advantagene); Oncos-102 (Oncos Therapeutics); CG0070 (Cold Genesys); Pexa-vac (JX-594, Jennerex Biotherapeutics); GL-ONC1

(Genelux); T-VEC (Amgen); G207 (Medigene); HF10 (Takara Bio); SEPREHVIR (HSV1716, Virttu Biologics); OrienX010 (OrienGene Biotechnology); Reolysin (Oncolytics Biotech); SVV-001 (Neotropix); Cacatak (CVA21, Viralytics); Alimta (Eli Lilly), cisplatin, oxaliplatin, irinotecan, folinic acid, methotrexate, cyclophosphamide, 5-fluorouracil, Zykadia (Novartis), Tafinlar (GSK), Xalkori (Pfizer), Iressa (AZ), Gilotrif (Boehringer Ingelheim), Tarceva (Astellas Pharma), Halaven (Eisai Pharma), Veliparib (Abbvie), AZD9291 (AZ), Alectinib (Chugai), LDK378 (Novartis), Genetespib (Synta Pharma), Tergenpumatucel-L (NewLink Genetics), GV1001 (Kael-GemVax), Tivantinib (ArQule); Cytoxan (BMS); Oncovin (Eli Lilly); Adriamycin (Pfizer); Gemzar (Eli Lilly); Xeloda (Roche); Ixempra (BMS); Abraxane (Celgene); Trelstar (Debiopharm); Taxotere (Sanofi); Nexavar (Bayer); IMMU-132 (Immunomedics); E7449 (Eisai); Thermodox (Celsion); Cometriq (Exellxis); Lonsurf (Taiho Pharmaceuticals); Camptosar (Pfizer); UFT (Taiho Pharmaceuticals); and TS-1 (Taiho Pharmaceuticals).

In some embodiments, the one or more *Erysipelatoclostridium* bacterial strains is/are the only therapeutically active agent(s) in a composition of the invention. In some embodiments, the bacterial strain(s) in the composition is/are the only therapeutically active agent(s) in a composition of the invention.

Asthma

In preferred embodiments, the compositions of the invention are for use in treating or preventing asthma. The compositions of the invention may achieve a reduction in the recruitment of neutrophils and/or eosinophils into the airways following sensitization and challenge with house dust mite extract and so they may be useful in the treatment or prevention of asthma. Asthma is a chronic disease characterized by inflammation and restriction of the airways. The inflammation in asthma may be mediated by IL-17 and/or Th17 cells, and so the compositions of the invention may be particularly effective for preventing or treating asthma. The inflammation in asthma may be mediated by eosinophils and/or neutrophils.

In certain embodiments, the asthma is eosinophilic or allergic asthma. Eosinophilic and allergic asthma are characterized by increased numbers of eosinophils in peripheral blood and in airway secretions and is associated pathologically with thickening of the basement membrane zone and pharmacologically by corticosteroid responsiveness [42]. Compositions that reduce or inhibit eosinophil recruitment or activation may be useful for treating or preventing eosinophilic and allergic asthma.

In additional embodiments, the compositions of the invention are for use in treating or preventing neutrophilic asthma (or non-eosinophilic asthma). High neutrophil numbers are associated with severe asthma that may be insensitive to corticosteroid treatment. Compositions that reduce or inhibit neutrophil recruitment or activation may be useful for treating or preventing neutrophilic asthma.

Eosinophilic and neutrophilic asthma are not mutually exclusive conditions and treatments that help address either the eosinophil and neutrophil responses may be useful for treating asthma in general.

Increased IL-17 levels and activation of the Th17 pathway are associated with severe asthma, so the compositions of the invention may be useful for preventing the development of severe asthma or for treating severe asthma.

In certain embodiments, the compositions of the invention are for use in methods reducing an eosinophilic inflammatory response in the treatment or prevention of asthma, or for use in methods of reducing a neutrophilic inflammatory response in the treatment or prevention of asthma. As noted above, high levels of eosinophils in asthma is associated pathologically with thickening of the basement membrane zone, so reducing eosinophilic inflammatory response in the treatment or prevention of asthma may be able to specifically address this feature of the disease. Also, elevated neutrophils, either in combination with elevated eosinophils or in their absence, is associated with severe asthma and chronic airway narrowing. Therefore, reducing the neutrophilic inflammatory response may be particularly useful for addressing severe asthma.

In certain embodiments, the compositions reduce peribronchiolar infiltration in allergic asthma, or are for use in reducing peribronchiolar infiltration in the treatment of allergic asthma. In certain embodiments, the compositions reduce peribronchiolar and/or perivascular infiltration in neutrophilic asthma, or are for use in reducing peribronchiolar and/or perivascular infiltration in the treatment of allergic neutrophilic asthma.

In certain embodiments, treatment with compositions of the invention provides a reduction or prevents an elevation in TNFα levels.

In certain embodiments, the compositions of the invention are for use in a method of treating asthma that results in a reduction of the eosinophilic and/or neutrophilic inflammatory response. In certain embodiments, the subject to be treated has, or has previously been identified as having, elevated neutrophil or eosinophil levels, for example as identified through blood sampling or sputum analysis.

The compositions of the invention may be useful for preventing the development of asthma in a new-born when administered to the new-born, or to a pregnant woman. The compositions may be useful for preventing the development of asthma in children. The compositions of the invention may be useful for treating or preventing adult-onset asthma. The compositions of the invention may be useful for managing or alleviating asthma. The compositions of the invention may be particularly useful for reducing symptoms associated with asthma that is aggravated by allergens, such as house dust mites.

Treatment or prevention of asthma may refer to, for example, an alleviation of the severity of symptoms or a reduction in the frequency of exacerbations or the range of triggers that are a problem for the subject.

Arthritis

In preferred embodiments, the compositions of the invention are for use in treating or preventing rheumatoid arthritis (RA). The compositions of the invention may achieve a reduction in the clinical signs of RA in a mouse model, reduce cartilage and bone damage, and reduce the IL-17 inflammatory response, and so they may be useful in the treatment or prevention of RA. RA is a systemic inflammatory disorder that primarily affects joints. RA is associated with an inflammatory response that results in swelling of joints, synovial hyperplasia, and destruction of cartilage and bone. IL-17 and Th17 cells may have a key role in RA, for example because IL-17 inhibits matrix production in chondrocytes and osteoblasts and activates the production and function of matrix metalloproteinases and because RA disease activity is correlated to IL-17 levels and Th-17 cell numbers [43,44], so the compositions of the invention may be particularly effective for preventing or treating RA.

In certain embodiments, the compositions of the invention are for use in lowering IL-17 levels or preventing elevation of IL-17 levels in the treatment or prevention of RA. In certain embodiments, treatment with compositions of the invention provides a reduction or prevents an elevation in IL-17 levels, in particular IL-17A levels. In certain embodiments, treatment with compositions of the invention provides a reduction or prevents an elevation in IFN-γ or IL-6 levels.

In certain embodiments, treatment with the compositions of the invention results in a reduction in the swelling of joints. In certain embodiments, the compositions of the invention are for use in subjects with swollen joints or subjects identified as at risk of having swollen joints. In certain embodiments, the compositions of the invention are for use in a method of reducing joint swelling in RA.

In certain embodiments, treatment with the compositions of the invention results in a reduction in cartilage damage or bone damage. In certain embodiments, the compositions of the invention are for use in reducing or preventing cartilage or bone damage in the treatment of RA. In certain embodiments, the compositions are for use in treating subject with severe RA that are at risk of cartilage or bone damage.

Increased IL-17 levels and Th17 cell numbers are associated with cartilage and bone destruction in RA [43,44]. IL-17 is known to activate matrix destruction in cartilage and bone tissue and IL-17 has an inhibitory effect on matrix production in chondrocytes and osteoblasts. Therefore, in certain embodiments, the compositions of the invention are for use in preventing bone erosion or cartilage damage in the treatment of RA. In certain embodiments, the compositions are for use in treating subjects that exhibit bone erosion or cartilage damage or subjects identified as at risk of bone erosion or cartilage damage.

TNF-α is also associated with RA, but TNF-α is not involved in the pathogenesis of the later stages of the disease. In contrast, IL-17 has a role throughout all stages of chronic disease [45]. Therefore, in certain embodiments the compositions of the invention are for use in treating chronic RA or late-stage RA, such as disease that includes joint destruction and loss of cartilage. In certain embodiments, the compositions of the invention are for treating subjects that have previously received anti-TNF-α therapy. In certain embodiments, the subjects to be treated do not respond or no longer respond to anti-TNF-α therapy.

The compositions of the invention may be useful for modulating a subject's immune system, so in certain embodiments the compositions of the invention are for use in preventing RA in a subject that has been identified as at risk of RA, or that has been diagnosed with early-stage RA. The compositions of the invention may be useful for preventing the development of RA.

The compositions of the invention may be useful for managing or alleviating RA. The compositions of the invention may be particularly useful for reducing symptoms associated with joint swelling or bone destruction. Treatment or prevention of RA may refer to, for example, an alleviation of the severity of symptoms or a reduction in the frequency of exacerbations or the range of triggers that are a problem for the subject.

Multiple Sclerosis

In preferred embodiments, the compositions of the invention are for use in treating or preventing multiple sclerosis. The compositions of the invention may achieve a reduction in the disease incidence and disease severity in a mouse model of multiple sclerosis (the EAE model), and so they may be useful in the treatment or prevention of multiple sclerosis. Multiple sclerosis is an inflammatory disorder associated with damage to the myelin sheaths of neurons, particularly in the brain and spinal column. Multiple sclerosis is a chronic disease, which is progressively incapacitating and which evolves in episodes. IL-17 and Th17 cells may have a key role in multiple sclerosis, for example because IL-17 levels may correlate with multiple sclerosis lesions, IL-17 can disrupt blood brain barrier endothelial cell tight junctions, and Th17 cells can migrate into the central nervous system and cause neuronal loss [46,47]. Therefore, the compositions of the invention may be particularly effective for preventing or treating multiple sclerosis.

In certain embodiments, treatment with the compositions of the invention results in a reduction in disease incidence or disease severity. In certain embodiments, the compositions of the invention are for use in reducing disease incidence or disease severity. In certain embodiments, treatment with the compositions of the invention prevents a decline in motor function or results in improved motor function. In certain embodiments, the compositions of the invention are for use in preventing a decline in motor function or for use in improving motor function. In certain embodiments, treatment with the compositions of the invention prevents the development of paralysis. In certain embodiments, the compositions of the invention are for use in preventing paralysis in the treatment of multiple sclerosis.

The compositions of the invention may be useful for modulating a subject's immune system, so in certain embodiments the compositions of the invention are for use in preventing multiple sclerosis in a subject that has been identified as at risk of multiple sclerosis, or that has been diagnosed with early-stage multiple sclerosis or "relapsing-remitting" multiple sclerosis. The compositions of the invention may be useful for preventing the development of sclerosis.

The compositions of the invention may be useful for managing or alleviating multiple sclerosis. The compositions of the invention may be particularly useful for reducing symptoms associated with multiple sclerosis. Treatment or prevention of multiple sclerosis may refer to, for example, an alleviation of the severity of symptoms or a reduction in the frequency of exacerbations or the range of triggers that are a problem for the subject.

Modes of Administration

Preferably, the compositions of the invention are to be administered to the gastrointestinal tract in order to enable delivery to and/or partial or total colonization of the intestine with the bacterial strain of the invention. Generally, the compositions of the invention are administered orally, but they may be administered rectally, intranasally, or via buccal or sublingual routes.

In certain embodiments, the compositions of the invention may be administered as a foam, as a spray or a gel.

In certain embodiments, the compositions of the invention may be administered as a suppository, such as a rectal suppository, for example in the form of a theobroma oil (cocoa butter), synthetic hard fat (e.g. suppocire, witepsol), glycero-gelatin, polyethylene glycol, or soap glycerin composition.

In certain embodiments, the composition of the invention is administered to the gastrointestinal tract via a tube, such as a nasogastric tube, orogastric tube, gastric tube, jejunostomy tube (J tube), percutaneous endoscopic gastrostomy (PEG), or a port, such as a chest wall port that provides access to the stomach, jejunum and other suitable access ports.

The compositions of the invention may be administered once, or they may be administered sequentially as part of a treatment regimen. In certain embodiments, the compositions of the invention are to be administered daily.

In certain embodiments of the invention, treatment according to the invention is accompanied by assessment of the subject's gut microbiota. Treatment may be repeated if delivery of and/or partial or total colonization with the strain of the invention is not achieved such that efficacy is not observed, or treatment may be ceased if delivery and/or partial or total colonization is successful and efficacy is observed.

In certain embodiments, the composition of the invention may be administered to a pregnant animal, for example a mammal such as a human in order to prevent an inflammatory or autoimmune disease developing in her child in utero and/or after it is born.

The compositions of the invention may be administered to a subject that has been diagnosed with a disease or condition mediated by IL-17 or the Th17 pathway, or that has been identified as being at risk of a disease or condition mediated by IL-17 or the Th17 pathway. The compositions may also be administered as a prophylactic measure to prevent the development of diseases or conditions mediated by IL-17 or the Th17 pathway in a healthy subject.

The compositions of the invention may be administered to a subject that has been identified as having an abnormal gut microbiota. For example, the subject may have reduced or absent colonization by *Erysipelatoclostridium*.

The compositions of the invention may be administered as a food product, such as a nutritional supplement.

Generally, the compositions of the invention are for the treatment of humans, although they may be used to treat animals including monogastric mammals such as poultry, pigs, cats, dogs, horses or rabbits. The compositions of the invention may be useful for enhancing the growth and performance of animals. If administered to animals, oral gavage may be used.

Compositions

Generally, the composition of the invention comprises bacteria. In preferred embodiments of the invention, the composition is formulated in freeze-dried form. For example, the composition of the invention may comprise granules or gelatin capsules, for example hard gelatin capsules, comprising a bacterial strain of the invention.

Preferably, the composition of the invention comprises lyophilized bacteria. Lyophilization of bacteria is a well-established procedure and relevant guidance is available in, for example, references [48-50].

Alternatively, the composition of the invention may comprise a live, active bacterial culture.

In some embodiments, the bacterial strain in the composition of the invention has not been inactivated, for example, has not been heat-inactivated. In some embodiments, the bacterial strain in the composition of the invention has not been killed, for example, has not been heat-killed. In some embodiments, the bacterial strain in the composition of the invention has not been attenuated, for example, has not been heat-attenuated. For example, in some embodiments, the bacterial strain in the composition of the invention has not been killed, inactivated and/or attenuated. For example, in some embodiments, the bacterial strain in the composition of the invention is live. For example, in some embodiments, the bacterial strain in the composition of the invention is viable. For example, in some embodiments, the bacterial strain in the composition of the invention is capable of at least partially or totally colonizing the intestine. For example, in some embodiments, the bacterial strain in the composition of the invention is viable and capable of at least partially or totally colonizing the intestine.

In some embodiments, the composition comprises a mixture of live bacterial strains and bacterial strains that have been killed.

In preferred embodiments, the composition of the invention is encapsulated to enable delivery of the bacterial strain to the intestine. Encapsulation protects the composition from degradation until delivery at the target location through, for example, rupturing with chemical or physical stimuli such as pressure, enzymatic activity, or physical disintegration, which may be triggered by changes in pH. Any appropriate encapsulation method may be used. Exemplary encapsulation techniques include entrapment within a porous matrix, attachment or adsorption on solid carrier surfaces, self-aggregation by flocculation or with cross-linking agents, and mechanical containment behind a microporous membrane or a microcapsule. Guidance on encapsulation that may be useful for preparing compositions of the invention is available in, for example, references [51] and [52].

The composition may be administered orally and may be in the form of a tablet, capsule or powder. Encapsulated products are preferred because *Erysipelatoclostridium ramosum* are anaerobes. Other ingredients (such as vitamin C, for example), may be included as oxygen scavengers and prebiotic substrates to improve the delivery and/or partial or total colonization and survival in vivo. Alternatively, the probiotic composition of the invention may be administered orally as a food or nutritional product, such as milk or whey based fermented dairy product, or as a pharmaceutical product.

The composition may be formulated as a probiotic.

A composition of the invention includes a therapeutically effective amount of a bacterial strain of the invention. A therapeutically effective amount of a bacterial strain is sufficient to exert a beneficial effect upon a subject. A therapeutically effective amount of a bacterial strain may be sufficient to result in delivery to and/or partial or total colonization of the subject's intestine.

A suitable daily dose of the bacteria, for example for an adult human, may be from about $1\times10^3$ to about $1\times10^{11}$ colony forming units (CFU); for example, from about $1\times10^7$ to about $1\times10^{10}$ CFU; in another example from about $1\times10^6$ to about $1\times10^{10}$ CFU. In certain embodiments, the composition contains the bacterial strain in an amount of from about $1\times10^6$ to about $1\times10^{11}$ CFU/g, respect to the weight of the composition; for example, from about $1\times10^8$ to about $1\times10^{10}$ CFU/g. The dose may be, for example, 1 g, 3 g, 5 g, and 10 g of the composition.

Typically, a probiotic, such as the composition of the invention, is optionally combined with at least one suitable prebiotic compound. A prebiotic compound is usually a non-digestible carbohydrate such as an oligo- or polysaccharide, or a sugar alcohol, which is not degraded or absorbed in the upper digestive tract. Known prebiotics include commercial products such as inulin and transgalacto-oligosaccharides.

In certain embodiments, the probiotic composition of the present invention includes a prebiotic compound in an amount of from about 1 to about 30% by weight, respect to the total weight composition, (e.g. from 5 to 20% by weight). Carbohydrates may be selected from the group consisting of: fructo-oligosaccharides (or FOS), short-chain fructo-oligosaccharides, inulin, isomalt-oligosaccharides, pectins, xylo-oligosaccharides (or XOS), chitosan-oligosaccharides (or COS), beta-glucans, arable gum modified and resistant starches, polydextrose, D-tagatose, acacia fibers, carob, oats, and citrus fibers. In one aspect, the prebiotics are the short-chain fructo-oligosaccharides (for simplicity shown herein below as FOSs-c.c); said FOSs-c.c. are not digestible carbohydrates, generally obtained by the conversion of the beet sugar and including a saccharose molecule to which three glucose molecules are bonded.

The compositions of the invention may comprise pharmaceutically acceptable excipients or carriers. Examples of such suitable excipients may be found in the reference [53]. Acceptable carriers or diluents for therapeutic use are well known in the pharmaceutical art and are described, for example, in reference [54]. Examples of suitable carriers include lactose, starch, glucose, methyl cellulose, magnesium stearate, mannitol, sorbitol and the like. Examples of suitable diluents include ethanol, glycerol and water. The choice of pharmaceutical carrier, excipient or diluent can be selected with regard to the intended route of administration and standard pharmaceutical practice. The pharmaceutical compositions may comprise as, or in addition to, the carrier, excipient or diluent any suitable binder(s), lubricant(s), suspending agent(s), coating agent(s), solubilizing agent(s). Examples of suitable binders include starch, gelatin, natural sugars such as glucose, anhydrous lactose, free-flow lactose, beta-lactose, corn sweeteners, natural and synthetic gums, such as acacia, tragacanth or sodium alginate, carboxymethyl cellulose and polyethylene glycol. Examples of suitable lubricants include sodium oleate, sodium stearate, magnesium stearate, sodium benzoate, sodium acetate, sodium chloride and the like. Preservatives, stabilizers, dyes and even flavoring agents may be provided in the pharmaceutical composition. Examples of preservatives include sodium benzoate, sorbic acid and esters of p-hydroxybenzoic acid. Antioxidants and suspending agents may be also used.

The compositions of the invention may be formulated as a food product. For example, a food product may provide nutritional benefit in addition to the therapeutic effect of the invention, such as in a nutritional supplement. Similarly, a food product may be formulated to enhance the taste of the composition of the invention or to make the composition more attractive to consume by being more similar to a common food item, rather than to a pharmaceutical composition. In certain embodiments, the composition of the invention is formulated with a nutritious product such as a milk-based product. The term "milk-based product" means any liquid or semi-solid milk- or whey-based product having a varying fat content. The milk-based product can be, e.g., cow's milk, goat's milk, sheep's milk, skimmed milk, whole milk, milk recombined from powdered milk and whey without any processing, or a processed product, such as yoghurt, curdled milk, curd, sour milk, sour whole milk, butter milk and other sour milk products. Another important group includes milk beverages, such as whey beverages, fermented milks, condensed milks, infant or baby milks; flavored milks, ice cream; milk-containing food such as sweets.

In some embodiments, the compositions of the invention comprise one or more bacterial strains of the genus *Erysipelatoclostridium* and do not contain bacteria from any other genus, or which comprise only de minimis or biologically irrelevant amounts of bacteria from another genus. Thus, in some embodiments, the invention provides a composition comprising one or more bacterial strains of the genus *Erysipelatoclostridium*, which does not contain bacteria from any other genus or which comprises only de minimis or biologically irrelevant amounts of bacteria from another genus, for use in therapy.

In certain embodiments, the compositions of the invention contain a single bacterial strain or species and do not contain any other bacterial strains or species. Such compositions may comprise only de minimis or biologically irrelevant amounts of other bacterial strains or species. Such compositions may be a culture that is substantially free from other species of organism. Thus, in some embodiments, the invention provides a composition comprising a single bacterial strain or species of the genus *Erysipelatoclostridium*, which does not contain bacteria from any other genus or which comprises only de minimis or biologically irrelevant amounts of bacteria from another genus for use in therapy. In some embodiments, the composition consists essentially of a bacteria strain of the genus *Erysipelatoclostridium*.

In some embodiments, the compositions of the invention comprise more than one bacterial strain or species. For example, in some embodiments, the compositions of the invention comprise more than one strain from within the same species (e.g. more than 1, 2, 3, 4, 5, 6, 7, 8, 9, 10, 15, 20, 25, 30, 35, 40 or 45 strains), and, optionally, do not contain bacteria from any other species. In some embodiments, the compositions of the invention comprise less than 50 strains from within the same species (e.g. less than 45, 40, 35, 30, 25, 20, 15, 12, 10, 9, 8, 7, 6, 5, 4 or 3 strains), and, optionally, do not contain bacteria from any other species. In some embodiments, the compositions of the invention comprise 1-40, 1-30, 1-20, 1-19, 1-18, 1-15, 1-10, 1-9, 1-8, 1-7, 1-6, 1-5, 1-4, 1-3, 1-2, 2-50, 2-40, 2-30, 2-20, 2-15, 2-10, 2-5, 6-30, 6-15, 16-25, or 31-50 strains from within the same species and, optionally, do not contain bacteria from any other species. In some embodiments, the compositions of the invention comprise more than one species from within the same genus (e.g. more than 1, 2, 3, 4, 5, 6, 7, 8, 9, 10, 12, 15, 17, 20, 23, 25, 30, 35 or 40 species), and, optionally, do not contain bacteria from any other genus. In some embodiments, the compositions of the invention comprise less than 50 species from within the same genus (e.g. less than 50, 45, 40, 35, 30, 25, 20, 15, 12, 10, 8, 7, 6, 5, 4 or 3 species), and, optionally, do not contain bacteria from any other genus. In some embodiments, the compositions of the invention comprise 1-50, 1-40, 1-30, 1-20, 1-15, 1-10, 1-9, 1-8, 1-7, 1-6, 1-5, 1-4, 1-3, 1-2, 2-50, 2-40, 2-30, 2-20, 2-15, 2-10, 2-5, 6-30, 6-15, 16-25, or 31-50 species from within the same genus and, optionally, do not contain bacteria from any other genus. The invention comprises any combination of the foregoing.

In some embodiments, the composition comprises a microbial consortium. For example, in some embodiments, the composition comprises the *Erysipelatoclostridium* bacterial strain as part of a microbial consortium. For example, in some embodiments, the *Erysipelatoclostridium* bacterial strain is present in combination with one or more (e.g. at least 2, 3, 4, 5, 10, 15 or 20) other bacterial strains from other genera with which it can live symbiotically in vivo in the intestine. For example, in some embodiments, the composition comprises a bacterial strain of *Erysipelatoclostridium ramosum* in combination with a bacterial strain from a different genus. In some embodiments, the microbial consortium comprises two or more bacterial strains obtained from a faeces sample of a single organism, e.g. a human. In some embodiments, the microbial consortium is not found together in nature. For example, in some embodiments, the microbial consortium comprises bacterial strains obtained from faeces samples of at least two different organisms. In some embodiments, the two different organisms are from the same species, e.g. two different humans. In some embodiments, the two different organisms are an infant human and an adult human. In some embodiments, the two different organisms are a human and a non-human mammal.

In some embodiments, the composition of the invention additionally comprises a bacterial strain that has the same safety and therapeutic efficacy characteristics as strain MRX027 deposited as NCIMB 42688, but which is not MRX027 deposited as NCIMB 42688, or which is not a *Erysipelatoclostridium ramosum* or which is not an *Erysipelatoclostridium*.

In some embodiments in which the composition of the invention comprises more than one bacterial strain, species or genus, the individual bacterial strains, species or genera may be for separate, simultaneous or sequential administration. For example, the composition may comprise all of the more than one bacterial strain, species or genera, or the bacterial strains, species or genera may be stored separately and be administered separately, simultaneously or sequentially. In some embodiments, the more than one bacterial strains, species or genera are stored separately but are mixed together prior to use.

In some embodiments, the bacterial strain for use in the invention is obtained from human adult faeces. In some embodiments in which the composition of the invention comprises more than one bacterial strain, all of the bacterial strains are obtained from human adult faeces or if other bacterial strains are present they are present only in de minimis amounts. The bacteria may have been cultured subsequent to being obtained from the human adult faeces and being used in a composition of the invention. As mentioned above, in some embodiments, the one or more *Erysipelatoclostridium* bacterial strains is/are the only therapeutically active agent(s) in a composition of the invention. In some embodiments, the bacterial strain(s) in the composition is/are the only therapeutically active agent(s) in a composition of the invention.

The compositions for use in accordance with the invention may or may not require marketing approval.

In certain embodiments, the invention provides the above pharmaceutical composition, wherein said bacterial strain is lyophilized. In certain embodiments, the invention provides the above pharmaceutical composition, wherein said bacterial strain is spray dried. In certain embodiments, the invention provides the above pharmaceutical composition, wherein the bacterial strain is lyophilized or spray dried and wherein it is live. In certain embodiments, the invention provides the above pharmaceutical composition, wherein the bacterial strain is lyophilized or spray dried and wherein it is viable. In certain embodiments, the invention provides the above pharmaceutical composition, wherein the bacterial strain is lyophilized or spray dried and wherein it is capable of at least partially or totally colonizing the intestine. In certain embodiments, the invention provides the above pharmaceutical composition, wherein the bacterial strain is lyophilized or spray dried and wherein it is viable and capable of at least partially or totally colonizing the intestine.

In some cases, the lyophilized or spray dried bacterial strain is reconstituted prior to administration. In some cases, the reconstitution is by use of a diluent described herein.

The compositions of the invention can comprise pharmaceutically acceptable excipients, diluents or carriers.

In certain embodiments, the invention provides a pharmaceutical composition comprising: a bacterial strain as used in the invention; and a pharmaceutically acceptable excipient, carrier or diluent; wherein the bacterial strain is in an amount sufficient to treat a disorder when administered to a subject in need thereof; and wherein the disorder is selected from the group consisting of uveitis; cancer, such as breast cancer, lung cancer, liver cancer, colon cancer, or ovarian cancer; multiple sclerosis; arthritis, such as rheumatoid arthritis, osteoarthritis, psoriatic arthritis, or juvenile idiopathic arthritis; neuromyelitis optica (Devic's disease); ankylosing spondylitis; spondyloarthritis; psoriasis; systemic lupus erythematosus; inflammatory bowel disease, such as Crohn's disease or ulcerative colitis; celiac disease; asthma, such as allergic asthma or neutrophilic asthma; chronic obstructive pulmonary disease (COPD); scleritis; vasculitis; Behcet's disease; atherosclerosis; atopic dermatitis; emphysema; periodontitis; allergic rhinitis; and allograft rejection.

In certain embodiments, the invention provides pharmaceutical composition comprising: a bacterial strain as used in the invention; and a pharmaceutically acceptable excipient, carrier or diluent; wherein the bacterial strain is in an amount sufficient to treat or prevent a disease or condition mediated by IL-17 or the Th17 pathway. In preferred embodiments, said disease or condition is selected from the group consisting of uveitis; cancer, such as breast cancer, lung cancer, liver cancer, colon cancer, or ovarian cancer; multiple sclerosis; arthritis, such as rheumatoid arthritis, osteoarthritis, psoriatic arthritis, or juvenile idiopathic arthritis; neuromyelitis optica (Devic's disease); ankylosing spondylitis; spondyloarthritis; psoriasis; systemic lupus erythematosus; inflammatory bowel disease, such as Crohn's disease or ulcerative colitis; celiac disease; asthma, such as allergic asthma or neutrophilic asthma; chronic obstructive pulmonary disease (COPD); scleritis; vasculitis; Behcet's disease; atherosclerosis; atopic dermatitis; emphysema; periodontitis; allergic rhinitis; and allograft rejection.

In certain embodiments, the invention provides the above pharmaceutical composition, wherein the amount of the bacterial strain is from about $1 \times 10^3$ to about $1 \times 10^{11}$ colony forming units per gram with respect to a weight of the composition.

In certain embodiments, the invention provides the above pharmaceutical composition, wherein the composition is administered at a dose of 1 g, 3 g, 5 g or 10 g.

In certain embodiments, the invention provides the above pharmaceutical composition, wherein the composition is administered by a method selected from the group consisting of oral, rectal, subcutaneous, nasal, buccal, and sublingual.

In certain embodiments, the invention provides the above pharmaceutical composition, comprising a carrier selected from the group consisting of lactose, starch, glucose, methyl cellulose, magnesium stearate, mannitol and sorbitol.

In certain embodiments, the invention provides the above pharmaceutical composition, comprising a diluent selected from the group consisting of ethanol, glycerol and water.

In certain embodiments, the invention provides the above pharmaceutical composition, comprising an excipient selected from the group consisting of starch, gelatin, glucose, anhydrous lactose, free-flow lactose, beta-lactose, corn sweetener, acacia, tragacanth, sodium alginate, carboxymethyl cellulose, polyethylene glycol, sodium oleate, sodium stearate, magnesium stearate, sodium benzoate, sodium acetate and sodium chloride.

In certain embodiments, the invention provides the above pharmaceutical composition, further comprising at least one of a preservative, an antioxidant and a stabilizer.

In certain embodiments, the invention provides the above pharmaceutical composition, comprising a preservative selected from the group consisting of sodium benzoate, sorbic acid and esters of p-hydroxybenzoic acid.

In certain embodiments, the invention provides the above pharmaceutical composition, wherein when the composition is stored in a sealed container at about 4° C. or about 25° C. and the container is placed in an atmosphere having 50% relative humidity, at least 80% of the bacterial strain as measured in colony forming units, remains after a period of at least about: 1 month, 3 months, 6 months, 1 year, 1.5 years, 2 years, 2.5 years or 3 years.

In some embodiments, the composition of the invention is provided in a sealed container comprising a composition as described herein. In some embodiments, the sealed container is a sachet or bottle. In some embodiments, the composition of the invention is provided in a syringe comprising a composition as described herein.

The composition of the present invention may, in some embodiments, be provided as a pharmaceutical formulation. For example, the composition may be provided as a tablet or capsule. In some embodiments, the capsule is a gelatine capsule ("gel-cap").

In some embodiments, the compositions of the invention are administered orally. Oral administration may involve swallowing, so that the compound enters the gastrointestinal tract, and/or buccal, lingual, or sublingual administration by which the compound enters the blood stream directly from the mouth.

Pharmaceutical formulations suitable for oral administration include solid plugs, solid microparticulates, semi-solid and liquid (including multiple phases or dispersed systems) such as tablets; soft or hard capsules containing multi- or nano-particulates, liquids (e.g. aqueous solutions), emulsions or powders; lozenges (including liquid-filled); chews; gels; fast dispersing dosage forms; films; ovules; sprays; and buccal/mucoadhesive patches.

In some embodiments the pharmaceutical formulation is an enteric formulation, i.e. a gastro-resistant formulation (for example, resistant to gastric pH) that is suitable for delivery of the composition of the invention to the intestine by oral administration. Enteric formulations may be particularly useful when the bacteria or another component of the composition is acid-sensitive, e.g. prone to degradation under gastric conditions.

In some embodiments, the enteric formulation comprises an enteric coating. In some embodiments, the formulation is an enteric-coated dosage form. For example, the formulation may be an enteric-coated tablet or an enteric-coated capsule, or the like. The enteric coating may be a conventional enteric coating, for example, a conventional coating for a tablet, capsule, or the like for oral delivery. The formulation may comprise a film coating, for example, a thin film layer of an enteric polymer, e.g. an acid-insoluble polymer.

In some embodiments, the enteric formulation is intrinsically enteric, for example, gastro-resistant without the need for an enteric coating. Thus, in some embodiments, the formulation is an enteric formulation that does not comprise an enteric coating. In some embodiments, the formulation is a capsule made from a thermogelling material. In some embodiments, the thermogelling material is a cellulosic material, such as methylcellulose, hydroxymethylcellulose or hydroxypropylmethylcellulose (HPMC). In some embodiments, the capsule comprises a shell that does not contain any film forming polymer. In some embodiments, the capsule comprises a shell and the shell comprises hydroxypropylmethylcellulose and does not comprise any film forming polymer (e.g. see [55]). In some embodiments, the formulation is an intrinsically enteric capsule (for example, Vcaps® from Capsugel).

In some embodiments, the formulation is a soft capsule. Soft capsules are capsules which may, owing to additions of softeners, such as, for example, glycerol, sorbitol, maltitol and polyethylene glycols, present in the capsule shell, have a certain elasticity and softness. Soft capsules can be produced, for example, on the basis of gelatine or starch. Gelatine-based soft capsules are commercially available from various suppliers. Depending on the method of administration, such as, for example, orally or rectally, soft capsules can have various shapes, they can be, for example, round, oval, oblong or torpedo-shaped. Soft capsules can be produced by conventional processes, such as, for example, by the Scherer process, the Accogel process or the droplet or blowing process.

Culturing Methods

The bacterial strains for use in the present invention can be cultured using standard microbiology techniques as detailed in, for example, references [56-58].

The solid or liquid medium used for culture may be YCFA agar or YCFA medium. YCFA medium may include (per 100 ml, approximate values): Casitone (1.0 g), yeast extract (0.25 g), NaHCO$_3$ (0.4 g), cysteine (0.1 g), K$_2$HPO$_4$ (0.045 g), KH$_2$PO$_4$ (0.045 g), NaCl (0.09 g), (NH$_4$)$_2$SO$_4$ (0.09 g), MgSO$_4$.7H$_2$O (0.009 g), CaCl$_2$ (0.009 g), resazurin (0.1 mg), hemin (1 mg), biotin (1 µg), cobalamin (1 µg), p-aminobenzoic acid (3 µg), folic acid (5 µg), and pyridoxamine (15 µg).

Bacterial Strains for Use in Vaccine Compositions

The inventors have identified that the bacterial strains of the invention are useful for treating or preventing diseases or conditions mediated by IL-17 or the Th17 pathway. This is likely to be a result of the effect that the bacterial strains of the invention have on the host immune system. Therefore, the compositions of the invention may also be useful for preventing diseases or conditions mediated by IL-17 or the Th17 pathway, when administered as vaccine compositions. In certain such embodiments, the bacterial strains of the invention are viable. In certain such embodiments, the bacterial strains of the invention are capable of at least partially or totally colonizing the intestine. In certain such embodiments, the bacterial strains of the invention are viable and capable of at least partially or totally colonizing the intestine. In other certain such embodiments, the bacterial strains of the invention may be killed, inactivated or attenuated. In certain such embodiments, the compositions may comprise a vaccine adjuvant. In certain embodiments, the compositions are for administration via injection, such as via subcutaneous injection.

General

The practice of the present invention will employ, unless otherwise indicated, conventional methods of chemistry, biochemistry, molecular biology, immunology and pharmacology, within the skill of the art. Such techniques are explained fully in the literature. See, e.g., references [59] and [60-66], etc.

A subject treated by a method described herein, or by contact with or administration of a composition described herein can be a mammalian subject who can be a human subject, a non-human primate, a canine mammal, a felid mammal or any other mammal. A subject maybe a patient who is a mammalian patient for instance, a human patient, a non-human primate, a canine mammal, a felid mammal or any other mammalian patient.

The term "comprising" encompasses "including" as well as "consisting" e.g. a composition "comprising" X may consist exclusively of X or may include something additional e.g. X+Y.

The term "about" in relation to a numerical value x is optional and means, for example, x±10%.

The word "substantially" does not exclude "completely" e.g. a composition which is "substantially free" from Y may be completely free from Y. Where necessary, the word "substantially" may be omitted from the definition of the invention.

References to a percentage sequence identity between two nucleotide sequences means that, when aligned, that percentage of nucleotides are the same in comparing the two sequences. This alignment and the percent homology or sequence identity can be determined using software programs known in the art, for example those described in section 7.7.18 of ref. [67]. A preferred alignment is determined by the Smith-Waterman homology search algorithm using an affine gap search with a gap open penalty of 12 and a gap extension penalty of 2, BLOSUM matrix of 62. The Smith-Waterman homology search algorithm is disclosed in ref. [68].

Unless specifically stated, a process or method comprising numerous steps may comprise additional steps at the beginning or end of the method, or may comprise additional intervening steps. Also, steps may be combined, omitted or performed in an alternative order, if appropriate.

Various embodiments of the invention are described herein. It will be appreciated that the features specified in each embodiment may be combined with other specified features, to provide further embodiments. In particular, embodiments highlighted herein as being suitable, typical or preferred may be combined with each other (except when they are mutually exclusive).

MODES FOR CARRYING OUT THE INVENTION

Example 1—Efficacy of Bacterial Inocula in a Mouse Model of Uveitis

Summary

This study used a mouse model of interphotoreceptor retinoid-binding protein (IRBP)-induced uveitis to test the effects of bacterial administration on uveitis. Uveitis is a sight-threatening condition resulting from intraocular inflammation and retinal tissue destruction. This disease can be studied in rodents in a model of experimental autoimmune uveoretinitis (EAU) [69]. EAU is an organ-specific disorder where Th1/Th17 cells are directed toward retinal antigens and produce cytokines that activate resident and infiltrating mononuclear cells leading to tissue destruction. EAU can be induced in mice by challenge with retinal antigens including interphotoreceptor retinoid binding protein peptide (IRBPp). Disease onset normally occurs from day 8-9 and peaks after days 14-15. Signs of clinical disease can be monitored using topical endoscopic fundal imaging (TEFI).

Strain

MRX027: *Erysipelatoclostridium ramosum*.

The strain used in this example has been deposited as NCIMB 42688.

Biotherapeutic was provided in glycerol stock. Microbiological growth media (YCFA) was used for the culture of the agent.

Mice

The mice were strain C57BL/6 and were over 6 weeks old at the beginning of the study. 72 mice were used (+36 Satellite animals). Unhealthy animals were excluded from the study. Animals were housed in specific pathogen free (spf) conditions, in a thermostatically monitored holding room (22±4° C.). Animals were allowed to acclimatize under standard animal house conditions for a minimum of one week prior to use. The health status of the animals was monitored throughout this period and the suitability of each animal for experimental use was assessed prior to study start. Mice were housed in groups of up to 10 animals per cage for the duration of the study. Irradiated pellet diet (Lab diet, EU Rodent diet 22%, 5LF5) and water were available ad libitum throughout the acclimatization and study periods. It is unlikely that any constituent of the diet or water interfered with the study.

Experimental Outline

Adult female C57BL/6 mice were randomly allocated to experimental groups and allowed to acclimatize for one week. Treatments were administered according to the schedule below. On Day 0, animals were administered with an emulsion containing 200 μg of interphotoreceptor retinoid binding protein peptide 1-20 (IRBP p1-20) in complete Freund's adjuvant (CFA) supplemented with 2.5 mg/ml *Mycobacterium Tuberculosis* H37 Ra by subcutaneous injection. Also on Day 0, animals were administered with 1.5 μg *Bordetella Pertussis* toxin by intra-peritoneal injection. From Day −14, animals are weighed three times per week. From Day −1 until the end of the experiment on Day 42, animals are monitored twice per week for clinical signs of uveitis using topical endoscopic fundal imaging (TEFI).

Administration Schedule

All Groups are n=12

Vehicle for oral administration is YCFA medium.

Administration volume for twice daily oral administration is 5 ml/kg.

| Group | Treatment | Dose | Route | Frequency | Disease Induction |
|---|---|---|---|---|---|
| 1 | Vehicle | 5 ml/kg | PO | BID | Day 0: IRBP/ |
| 2 | MRX027 | 5 ml/kg | | Day −14-End | CFA, SC |
| | | | | | Day 0: PTx, IP |

PO: oral administration,
BID: twice daily,
SC: subcutaneous injection,
IP: intra-peritoneal injection,
IRBP: interphotoreceptor binding protein,
CFA: complete Freund's adjuvant,
PTx: Pertussis toxin A positive control group was also tested using treatment with the drug cyclosporin A.

Readouts

Bodyweights. From Day −14, animals are weighed three times a week. Animals with a bodyweight loss equal to or greater than 15% of their initial (Day 0) bodyweight on two consecutive occasions are culled.

Non-specific clinical observations. From Day −14 until the end of the experiment, animals are checked daily for non-specific clinical signs to include abnormal posture (hunched), abnormal coat condition (piloerection) and abnormal activity levels (reduced or increased activity).

Clinical Scores: Retinal imaging by topical endoscopic fundal imaging (TEFI). From Day −1 until the end of the experiment, animals are scored twice per week for clinical signs of uveitis. Retinal images are captured using TEFI in non-anaesthetized but restrained animals following pupil dilatation using Tropicamide 1% then Phenylephrine hydrochloride 2.5%. Retinal images are scores using the following system. The maximum cumulative score is 20.

| Score | Optic disc Inflammation | Retinal vessels | Retinal tissue Infiltration | Structural damage |
|---|---|---|---|---|
| 1 | Minimal | 1-4 mild cuffings | 1-4 small lesions or 1 linear lesion | Retinal lesions or atrophy involving ¼ to ¾ of retinal area |
| 2 | Mild | >4 mild cuffings or 1-3 moderate cuffings | 5-10 small lesions or 2-3 linear lesions | Panretinal atrophy with multiple small lesions (scars) or ≤3 linear lesions (scars) |
| 3 | Moderate | >3 moderate cuffings | >10 small lesions or >3 linear lesions | Panretinal atrophy with >3 linear lesions or confluent lesions (scars) |
| 4 | Severe | >1 severe cuffings | Linear lesion confluent | Retinal detachment with folding |
| 5 | | | Not visible (white-out or severe detachment) | |

Results

Figure 2:
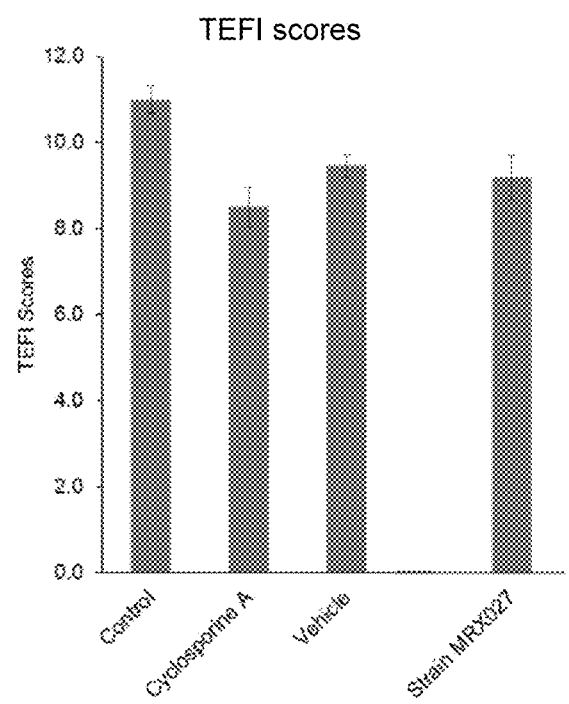
FIG. 2: Mouse model of uveitis—TEFI Scores on Day 28. Data are presented as Mean±SEM.

The results of the study are shown in FIGS. 1 and 2.

Clinical Scores: Retinal imaging by topical endoscopic fundal imaging (TEFI). TEFI scores data measured in the Control group from Day 0 until Day 28 were analyzed by Kruskal-Wallis test for non-parametric data followed by Dunn's post-test for multiple comparisons between experimental days.

IRBP administration induced a significant increase in the TEFI scores measured from Day 14 ($p<0.01$) and on Day 28 ($p<0.0001$) when compared to Day 0 in the Control group (FIG. 1).

TEFI scores measured in the experimental groups on Day 28 were analyzed using a one-way ANOVA. As expected, a significant decrease in the scores was observed in the positive control cyclosporine A group. There was also a statistically significant decrease in the scores for the MRX027-treated group ($p<0.05$), relative to the negative control (FIG. 73).

Conclusions. Clinical scores determined by TEFI increased from Day 14, as expected in this model of IRBP-induced uveitis. By Day 28, a striking and statistically significant reduction in disease incidence and disease severity was observed in the MRX027-treated group, which was comparable to that seen for the positive control group. In particular, these data indicate that treatment with the strain MRX027 reduced retinal damage, optic disc inflammation and/or retinal tissue infiltration by inflammatory cells (see TEFI retinal image scoring system above). These data indicate the strain MRX027 may be useful for treating or preventing uveitis.

Example 2—Stability Testing

A composition described herein containing at least one bacterial strain described herein is stored in a sealed container at 25° C. or 4° C. and the container is placed in an atmosphere having 30%, 40%, 50%, 60%, 70%, 75%, 80%, 90% or 95% relative humidity. After 1 month, 2 months, 3 months, 6 months, 1 year, 1.5 years, 2 years, 2.5 years or 3 years, at least 50%, 60%, 70%, 80% or 90% of the bacterial strain shall remain as measured in colony forming units determined by standard protocols.

SEQUENCES

SEQ ID NO: 1 (*Erysipelatoclostridium* (*Clostridium*) ramosum 16S rRNA gene, strain DSM 1402-X73440)

```
   1 nnnnnnngag agtttgatcc tggctcagga tgaacgctgg cggcgtgcct aatacatgca
  61 agtcgaacgc gagcacttgt gctcgagtgg cgaacgggtg agtaatacat aagtaacctg
 121 ccctagacag ggggataact attggaaacg gatagctaag accgcatagg tacggacact
 181 gcatggtgac cgtattaaaa gtgcctcaaa gcactggtag aggatggact tatggcgcat
 241 tagctggttg gcggggtaac ggcccaccaa ggcgacgatg cgtagccgac ctgagagggt
 301 gaccggccac actgggactg agacacggcc cagactccta cgggaggcag cagtagggaa
 361 ttttcggcaa tgggggaaac cctgaccgag caacgccgcg tgaaggaaga aggttttcgg
 421 attgtaaact tctgttataa agaagaacgg cggctacagg aaatggtagc cgagtgacgg
 481 tactttattt tagaaagcca cggctaacta cgtgccagca gccgcggtaa tacgtaggtg
 541 gcaagcgtta tccggaatta ttgggcgtaa agagggagca ggcggcagca agggtctgtg
 601 gtgaaagcct gaagcttaac ttcagtaagc catagaaacc aggcagctag agtgcaggag
 661 aggatcgtgg aattccatgt gtagcggtga aatgcgtaga tatatggagg aacaccagtg
 721 gcgaaggcga cgatctggcc tgcaactgac gctcagtccc gaaagcgtgg ggagcaaata
 781 ggattagata ccctagtagt ccacgccgta aacgatgagt actaagtgtt ggatgtcaaa
 841 gttcagtgct gcagttaacg caataagtac tccgcctgag tagtacgttc gcaagaatga
 901 aactcaaagg aattgacggg ggccgcacaa gcggtggagc atgtggttta attcgaagca
 961 acgcgaagaa ccttaccagg tcttgacata ctcataaagg ctccagagat ggagagatag
1021 ctatatgaga tacaggtggt gcatggttgt cgtcagctcg tgtcgtgaga tgttgggtta
1081 agtcccgcaa cgagcgcaac ccttatcgtt agttaccatc attaagttgg ggactctagc
1141 gagactgcca gtgacaagct ggaggaaggc ggggatgacg tcaaatcatc atgcccctta
1201 tgacctgggc tacacacgtg ctacaatgga tggtgcagag ggaagcgaac cgcgaggtga
1261 agcaaaaccc ataaaaacca ttctcagttc ggattgtagt ctgcaactcg actacatgaa
1321 gttggaatcg ctagtaatcg cgaatcagca tgtcgcggtg aatacgttct cgggccttgt
1381 acacaccgcc cgtcacacca cgagagttga taacacccga agccggtggc ctaaccgcaa
1441 ggaaggagct gtctaaggtg ggattgatga ttggggtgaa gtcgtaacaa ggtatccta
1501 cgggaacgtg cggctggatc acctcc
```

SEQUENCES

SEQ ID NO: 2 (*Erysipelatoclostridium ramosum* strain JCM 1298 16S ribosomal RNA gene, partial sequence-NR_113243.1)

```
   1   agagtttgat cctggctcag gatgaacgct ggcggcgtgc ctaatacatg caagtcgaac
  61   gcgagcactt gtgctcgagt ggcgaacggg tgagtaatac ataagtaacc tgccctagac
 121   aggggataa  ctattggaaa cgatagctaa gaccgcatag gtacggacac tgcatggtga
 181   ccgtattaaa agtgcctcaa agcactggta gaggatggac ttatggcgca ttagctggtt
 241   ggcggggtaa cggcccacca aggcgacgat gcgtagccga cctgagaggg tgaccggcca
 301   cactgggact gagacacggc ccagactcct acgggaggca gcagtaggga attttcggca
 361   atgggggaaa ccctgaccga gcaacgccgc gtgaaggaag aaggttttcg gattgtaaac
 421   ttctgttata aaggaagaac ggcggctaca ggaaatggta gccgagtgac ggtactttat
 481   tagaaagcca cggctaacta cgtgccagca gccgcggtaa tacgtaggtg gcaagcgtta
 541   tccggaatta ttgggcgtaa agagggagca ggcggcagca agggtctgtg gtgaaagcct
 601   gaagcttaac ttcagtaagc catagaaacc aggcagctag agtgcaggag aggatcgtgg
 661   aattccatgt gtagcggtga aatgcgtaga tatatggagg aacaccagtg gcgaaggcga
 721   cgatctggcc tgcaactgac gctcagtccc gaaagcgtgg ggagcaaata ggattagata
 781   ccctagtagt ccacgccgta aacgatgagt actaagtgtt ggatgtcaaa gttcagtgct
 841   gcagttaacg caataagtac tccgcctgag tagtacgttc gcaagaatga aactcaaagg
 901   aattgacggg ggcccgcaca agcggtggag catgtggttt aattcgaagc aacgcgaaga
 961   accttaccag gtcttgacat actcataaag gctccagaga tggagagata gctatatgag
1021   atacaggtgg tgcatggttg tcgtcagctc gtgtcgtgag atgttgggtt aagtcccgca
1081   acgagcgcaa cccttatcgt tagttaccat cattaagttg gggactctag cgagactgcc
1141   agtgacaagc tggaggaagg cggggatgac gtcaaatcat catgcccctt atgacctggg
1201   ctacacacgt gctacaatgg atggtgcaga gggaagcgaa gccgcgaggt gaagcaaaac
1261   ccataaaacc attctcagtt cggattgtag tctgcaactc gactacatga agttggaatc
1321   gctagtaatc gcgaatcagc atgtcgcggt gaatacgttc tcgggccttg tacacaccgc
1381   ccgtcacacc acgagagttg ataacacccg aagccggtgg cctaaccgca aggaaggagc
1441   tgtctaaggt gggattgatg attggggtga agtcgtaaca aggtaacc
```

SEQ ID NO: 3 (consensus 16S rRNA sequence for *Erysipelatoclostridium ramosum* strain MRX027)

```
TGCGGTTAGGCCACCGGCTTCGGGTGTTATCAACTCTCGTGGTGTGACGGGCGGTGT
GTACAAGGCCCGAGAACGTATTCACCGCGACATGCTGATTCGCGATTACTAGCGATT
CCAACTTCATGTAGTCGAGTTGCAGACTACAATCCGAACTGAGAATGGTTTTATGGG
TTTTGCTTCACCTCGCGGCTTCGCTTCCCTCTGCACCATCCATTGTAGCACGTGTGTA
GCCCAGGTCATAAGGGGCATGATGATTTGACGTCATCCCCGCCTTCCTCCAGCTTGT
CACTGGCAGTCTCGCTAGAGTCCCCAACTTAATGATGGTAACTAACGATAAGGGTTG
CGCTCGTTGCGGGACTTAACCCAACATCTCACGACACGAGCTGACGACAACCATGC
ACCACCTGTATCTCATATAGCTATCTCTCCATCTCTGGAGCCTTTATGAGTATGTCAA
GACCTGGTAAGGTTCTTCGCGTTGCTTCGAATTAAACCACATGCTCCACCGCTTGTG
CGGGCCCCCGTCAATTCCTTTGAGTTTCATTCTTGCGAACGTACTACTCAGGCGGAG
TACTTATTGCGTTAACTGCAGCACTGAACTTTGACATCCAACACTTAGTACTCATCGT
TTACGGCGTGGACTACTAGGGTATCTAATCCTATTTGCTCCCCACGCTTTCGGGACT
GAGCGTCAGTTGCAGGCCAGATCGTCGCCTTCGCCACTGGTGTTCCTCCATATATCT
ACGCATTTCACCGCTACACATGGAATTCCACGATCCTCTCCTGCACTCTAGCTGCCT
GGTTTCTATGGCTTACTGAAGTTAAGCTTCAGGCTTTCACCACAGACCCTTGCTGCC
GCCTGCTCCCTCTTTACGCCCAATAATTCCGGATAACGCTTGCCACCTACGTATTACC
GCGGCTGCTGGCACGTAGTTAGCCGTGGCTTTCTAATAAAGTACCGTCACTCGGCTA
CCATTTCCTGTAGCCGCCGTTCTTCCTTTATAACAGAAGTTTACAATCCGAAAACCTT
CTTCCTTCACGCGGCGTTGCTCGGTCAGGGTTTCCCCCATTGCCGAAAATTCCCTACT
GCTGCCTCCCGTAGGAGTCTGGGCCGTGTCTCAGTCCCAGTGTGGCCGGTCACCCTC
TCAGGTCGGCTACGCATCGTCGCCTTGGTGGGCCGTTACCCCGCCAACCAGCTAATG
CGCCATAAGTCCATCCTCTACCAGTGCTTTGAGGCACTTTTAATACGGTCACCATGC
AGTGTCCGTACCTATGCGGTCTTAGCTATCGTTTCCAATAGTTATCCCCCTGTCTAGG
GCAGGTTACTTATGTATTACTCACCCGTTCGCCACTCGAGCACAAGTGCTCGC
```

SEQ ID NO: 4 (genome sequence of *Erysipelatoclostridium ramosum* strain DSM 140)-see electronic sequence listing.

REFERENCES

[1] Spor et al. (2011) *Nat Rev Microbial.* 9(4):279-90.
[2] Eckburg et al. (2005) *Science.* 10; 308(5728):1635-8.
[3] Macpherson et al. (2001) *Microbes Infect.* 3(12):1021-35
[4] Macpherson et al. (2002) *Cell Mol Life Sci.* 59(12):2088-96.
[5] Mazmanian et al. (2005) *Cell* 15; 122(1):107-18.
[6] Frank et al. (2007) *PNAS* 104(34):13780-5.
[7] Scanlan et al. (2006) *J Clin Microbiol.* 44(11):3980-8.
[8] Kang et al. (2010) *Inflamm Bowel Dis.* 16(12):2034-42.
[9] Machiels et al. (2013) *Gut.* 63(8):1275-83.
[10] WO 2013/050792
[11] WO 03/046580
[12] WO 2013/008039
[13] WO 2014/167338
[14] Goldin and Gorbach (2008) *Clin Infect Dis.* 46 Suppl 2:S96-100.
[15] Azad et al. (2013) *BMJ.* 347:f6471.
[16] WO2015/095241
[17] WO2015/156419
[18] Yutin and Galperin (2013) *Environ Microbiol.* 15(10): 2631-2641.
[19] Masco et al. (2003) *Systematic and Applied Microbiology,* 26:557-563.
[20] Srůtková et al. (2011) *J. Microbiol. Methods,* 87(1): 10-6.
[21] Ye et al. (2015) *PLoS One.* 10(1):e0117704.

[22] Fabro et al. (2015) *Immunobiology*. 220(1):124-35.
[23] Yin et al. (2014) *Immunogenetics*. 66(3):215-8.
[24] Cheluvappa et al. (2014) *Clin Exp Immunol*. 175 (2): 316-22.
[25] Schieck et al. (2014) *J Allergy Clin Immunol*. 133(3): 888-91.
[26] Balato et al. (2014) *J Eur Acad Dermatol Venereol*. 28(8): 1016-24.
[27] Monteleone et al. (2011) *BMC Medicine*. 2011, 9:122.
[28] Zhang (2015) *Inflammation*. August 23.
[29] Sun et al. (2015) *Cytokine*. 74(1):76-80.
[30] Mucientes et al. (2015) *Br J Ophthalmol*. 99(4):566-70.
[31] Jawad et al. (2013) *Ocul Immunol Inflamm*. 21(6):434-9.
[32] Maya et al. (2014) *J. Ophthalmology*. 310329
[33] Chi et al. (2007) *J. Allergy and Clinical Immunology*. 119 (5): 1218-1224.
[34] Chi et al. (2008) *Investigative Ophthalmology & Visual Science*. 49(7): 3058-3064.
[35] Luger and Caspi (2008) *Semin. Immunopathol*. 30(2): 134-143.
[36] Numasaki et al. (2003) *Blood*. 101:2620-2627.
[37] Zhang et al. (2008) *Biochem. Biophys. Res. Commun*. 374: 533-537.
[38] Karin (2006) *Nature*. 441: 431-436.
[39] Faghih et al. (2013). *Iranian Journal of Immunology*. 10(4): 193-204.
[40] Numasaki et al. (2005) *J. Immunol*. 175: 6177-6189
[41] Hammerich and Tacke (2014) *Clin Exp Gastroenterol*. 7:297-306.
[42] Fahy (2009) *Proc Am Thorac Soc* 6.256-259
[43] Miossec and Kolls (2012) *Nat Rev Drug Discov*. 11(10):763-76.
[44] Yang et al. (2014) *Trends Pharmacol Sci*. 35(10):493-500.
[45] Koenders et al. (2006) *J. Immunol*. 176:6262-6269.
[46] Amedei et al. (2012) *Int J Mol Sci*. 13(10): 13438-60.
[47] Shabgah et al. (2014) *Postepy. Dermatol. Alergol*. 31(4):256-61.
[48] Miyamoto-Shinohara et al. (2008) *J. Gen. Appl. Microbiol.*, 54, 9-24.
[49] Cryopreservation and Freeze-Drying Protocols, ed. by Day and McLellan, Humana Press.
[50] Leslie et al. (1995) *Appl. Environ. Microbiol*. 61, 3592-3597.
[51] Mitropoulou et al. (2013) *J Nutr Metab*. (2013) 716861.
[52] Kailasapathy et al. (2002) *Curr Issues Intest Microbiol*. 3(2):39-48.
[53] Handbook of Pharmaceutical Excipients, 2nd Edition, (1994), Edited by A Wade and P J Weller
[54] Remington's Pharmaceutical Sciences, Mack Publishing Co. (A. R. Gennaro edit. 1985)
[55] US 2016/0067188
[56] *Handbook of Microbiological Media, Fourth Edition* (2010) Ronald Atlas, CRC Press.
[57] *Maintaining Cultures for Biotechnology and Industry* (1996) Jennie C. Hunter-Cevera, Academic Press
[58] Strobel (2009) *Methods Mol Biol*. 581:247-61.
[59] Gennaro (2000) *Remington: The Science and Practice of Pharmacy*. 20th edition, ISBN: 0683306472.
[60] *Molecular Biology Techniques: An Intensive Laboratory Course*, (Ream et al., eds., 1998, Academic Press).
[61] *Methods In Enzymology* (S. Colowick and N. Kaplan, eds., Academic Press, Inc.)
[62] *Handbook of Experimental Immunology*, Vols. I-IV (D. M. Weir and C. C. Blackwell, eds, 1986, Blackwell Scientific Publications)
[63] Sambrook et al. (2001) *Molecular Cloning: A Laboratory Manual*, 3rd edition (Cold Spring Harbor Laboratory Press).
[64] *Handbook of Surface and Colloidal Chemistry* (Birdi, K. S. ed., CRC Press, 1997)
[65] Ausubel et al. (eds) (2002) *Short protocols in molecular biology*, 5th edition (Current Protocols).
[66] *PCR (Introduction to Biotechniques Series)*, 2nd ed. (Newton & Graham eds., 1997, Springer Verlag)
[67] *Current Protocols in Molecular Biology* (F. M. Ausubel et al., eds., 1987) Supplement 30
[68] Smith & Waterman (1981) *Adv. Appl. Math*. 2: 482-489.
[69] Caspi (2003) *Curr Protoc Immunol. Chapter* 15:Unit 15.6.

---

SEQUENCE LISTING (5 sequences)

SEQ ID NO: 1 - DNA, 1526 bp, Erysipelatoclostridium ramosum
  Erysipelatoclostridium ramosum DSM 1402
  modified_base (1)..(7): a, c, t, g, unknown or other
nnnnnnngagagtttgatcctggctcaggatgaacgctggcggcgtgcctaatacatgcaagtcgaacgcgagcacttgtgctcgagtggcgaacgggtgagtaatacataagtaacctgccctagacagggggataactattggaaacggatagctaagaccgcataggtacggacactgcatggtgaccgtattaaaagtgcctcaaagcactggtagaggatggacttatggcgcattagctggttggcggggtaacggcccaccaaggcgacgatgcgtagccgacctgagagggtgaccggccacactgggactgagacacggcccagactcctacgggaggcagcagtagggaattttcggcaatgggggaaaccctgaccgagcaacgccgcgtgaaggaagaaggttttcggattgtaaacttctgttataaagaagaacggcggctacaggaaatggtagccgagtgacggtactttattttagaaagccacggctaactacgtgccagcagccgcggtaatacgtaggtggcaagcgttatccggaattattgggcgtaaagagggagcaggcggcagcaagggtctgtggtgaaagcctgaagcttaacttcagtaagccatagaaaccaggcagctagagtgcaggagaggatcgtggaattccatgtgtagcggtgaaatgcgtagatatatggaggaacaccagtggcgaaggcgacgatctggcctgcaactgacgctcagtcccgaaagcgtggggagcaaataggattagataccctagtagtccacgccgtaaacgatgagtactaagtgttggatgtcaaagttcagtgctgcagttaacgcaataagtactccgcctgagtagtacgttcgcaagaatgaaactcaaaggaattgacgggggccgcacaagcggtggagcatgtggtttaattcgaagcaacgcgaagaaccttaccaggtcttgacatactcataaaggctccagagatggagagatagctatatgagatacaggtggtgcatggttgtcgtcagctcgtgtcgtgagatgttgggttaagtcccgcaacgagcgcaacccttatcgttagttaccatcattaagttggggactctagcgagactgccagtgacaagctggaggaaggcggggatgacgtcaaatcatcatgccccttatgacctgggctacacacgtgctacaatggatggtgcagagggaagcgaaccgcgaggtgaagcaaaacccataaaaaccattctcagttcggattgtagtctgcaactcgactacatgaagttggaatcgctagtaatcgcgaatcagcatgtcgcggtgaatacgttctcgggccttgtacacaccgcccgtcacaccacgagagttgataacacccgaagccggtggcctaaccgcaaggaaggagctgtctaaggtgggattgatgattggggtgaagtcgtaacaaggtatccctacgggaacgtgcggctggatcacctcc

SEQ ID NO: 2 - DNA, 1488 bp, Erysipelatoclostridium ramosum
agagtttgatcctggctcaggatgaacgctggcggcgtgcctaatacatgcaagtcgaacgcgagcacttgtgctcgagtggcgaacgggtgagtaatacataagtaacctgccctagacagggggataactattggaaacgatagctaagaccgcataggtacggacactgcatggtgaccgtattaaaagtgcctcaaagcactggtagaggatggacttatggcgcattagctggttggcggggtaacggcccaccaaggcgacgatgcgtagccgacctgagagggtgaccggccacactgggactgagacacggcccagactcctacgggaggcagcagtagggaattttcggcaatgggggaaaccctgaccgagcaacgccgcgtgaaggaagaaggttttcggattgtaaacttctgttataaaggaagaacggcggctacaggaaatggtagccgagtgacggtactttattagaaagccacggctaactacgtgccagcagccgcggtaatacgtaggtggcaagcgttatccggaattattgggcgtaaagagggagcaggcggcagcaagggtctgtggtgaaagcctgaagcttaacttcagtaagccatagaaaccaggcagctagagtgcaggagaggatcgtggaattccatgtgtagcggtgaaatgcgtagatatatggaggaacaccagtggcgaaggcgacgatctggcctgcaactgacgctcagtcccgaaagcgtggggagcaaataggattagataccctagtagtccacgccgtaaacgatgagtactaagtgttggatgtcaaagttcagtgctgcagttaacgcaataagtactccgcctgagtagtacgttcgcaagaatgaaactcaaaggaattgacgggggcccgcacaagcggtggagcatgtggtttaattcgaagcaacgcgaagaaccttaccaggtcttgacatactcataaaggctccagagatggagagatagctatatgagatacaggtggtgcatggttgtcgtcagctcgtgtcgtgagatgttgggttaagtcccgcaacgagcgcaacccttatcgttagttaccatcattaagttggggactctagcgagactgccagtgacaagctggaggaaggcggggatgacgtcaaatcatcatgccccttatgacctgggctacacacgtgctacaatggatggtgcagagggaagcgaagccgcgaggtgaagcaaaacccataaaaccattctcagttcggattgtagtctgcaactcgactacatgaagttggaatcgctagtaatcgcgaatcagcatgtcgcggtgaatacgttctcgggccttgtacacaccgcccgtcacaccacgagagttgataacacccgaagccggtggcctaaccgcaaggaaggagctgtctaaggtgggattgatgattggggtgaagtcgtaacaaggtaacc

SEQ ID NO: 3 - DNA, 1370 bp, Erysipelatoclostridium ramosum
  Erysipelatoclostridium ramosum MRX027
tgcggttaggccaccggcttcgggtgttatcaactctcgtggtgtgacgggcggtgtgtacaaggcccgagaacgtattcaccgcgacatgctgattcgcgattactagcgattccaacttcatgtagtcgagttgcagactacaatccgaactgagaatggttttatgggttttgcttcacctcgcggcttcgcttccctctgcaccatccattgtagcacgtgtgtagcccaggtcataaggggcatgatgatttgacgtcatccccgccttcctccagcttgtcactggcagtctcgctagagtccccaacttaatgatggtaactaacgataagggttgcgctcgttgcgggacttaacccaacatctcacgacacgagctgacgacaaccatgcaccacctgtatctcatatagctatctctccatctctggagcctttatgagtatgtcaagacctggtaaggttcttcgcgttgcttcgaattaaaccacatgctccaccgcttgtgcgggcccccgtcaattcctttgagtttcattcttgcgaacgtactactcaggcggagtacttattgcgttaactgcagcactgaactttgacatccaacacttagtactcatcgtttacggcgtggactactagggtatctaatcctatttgctccccacgctttcgggactgagcgtcagttgcaggccagatcgtcgccttcgccactggtgttcctccatatatctacgcatttcaccgctacacatggaattccacgatcctctcctgcactctagctgcctggtttctatggcttactgaagttaagcttcaggctttcaccacagacccttgctgccgcctgctccctctttacgcccaataattccggataacgcttgccacctacgtattaccgcggctgctggcacgtagttagccgtggctttctaataaagtaccgtcactcggctaccatttcctgtagccgccgttcttcctttataacagaagtttacaatccgaaaaccttcttccttcacgcggcgttgctcggtcagggtttcccccattgccgaaaattccctactgctgcctcccgtaggagtctgggccgtgtctcagtcccagtgtggccggtcaccctctcaggtcggctacgcatcgtcgccttggtgggccgttaccccgccaaccagctaatgcgccataagtccatcctctaccagtgctttgaggcacttttaatacggtcaccatgcagtgtccgtacctatgcggtcttagctatcgtttccaatagttatccccctgtctagggcaggttacttatgtattactcacccgttcgccactcgagcacaagtgctcgc

SEQ ID NO: 4 - DNA, 965322 bp, Erysipelatoclostridium ramosum
  Erysipelatoclostridium ramosum DSM 1402
gtggcaggtctcgcctgtggtggattctcgaaactaagaattttcatcactaaaaaacataaatcgaaaggaaggatggattttagtaaatagttgaaaatagtaatcaagcaaacaccaaaataggtaaagtaagaaagagcgtatggcggatgcctaggcacagagaggcgaagaaggacgcagcaaacagcgaaatgcgacggttagcagtaagcatgcaacgatccgtcgatgtccgaatgggggaacccacctggagtagagaccaggtatcctgaagtgaataaatagcttcagagaggcgagactcagggaactgaaacatctaagtacctgaaggaagagaaaataaacgaatgattccctaagtagcggcgagcgaaaggggaagagcccaaaccgatcttaggatcggggttgtaggactgtcggcaaagagcaagaaatcattataggcgaacggaatgggaagtccggcgaaacagggtgacagccccgtagccgaaatagtgaagaagcacgagacagcacctgagtacggcgggacacgaggaatcctgtcggaatccaccaggaccatctggtaaggctaaatactcctctgtgaccgatagtgaaccagtaccgtgagggaaaggtgaaaagaaccccgggaggggagtgaaatagaacctgaaaccatatgcttacaagaagttagagcccgttaaagggtgatagcgtgccttttgtagaatgaaccggcgagttacgatatggagcgaggttaagcaggatatgcggagccgaagcgaaagcgagtcttaacagggcgaaagttgcatgtcgtagacccgaaaccgagtgatctagccatgaccaggttgaagttggggtaaaacccgatggaggaccgaaccgacccccgttgaaacgttggcggatgagttgtggctaggggtgaaattccaatcgaactcggagatagctggttctccccgaaatagctttagggctagcgtcgaggtaaagtcgtgtgaaggtagagcactgaatatgtgatggccccatctcggggtactgaacataatcaaactccgaatgtcacaaagatatactcggcagtcagacagtgggtgataaggtccattgtcaaaagggaaacagcccagaccatcagctaaggtcccaaaatatatactaagtggaaaaggatgtggagatgtccagacaactaggaggttggctcagaagcagccatcctttaaagagtgcgtaacagctcactagtcgaatgactctgcgccgataatttaccggggctaagtatattaccgaagctatggatttacgcgtaagcgtgagtggtaggggagcgttctatgtgcggagaagcggtaccgtaaggagccgtggagcgcatagaagagagaatgccggtgtgagtagcgaaacgtgggtgagaatcccacgcaccgaaaacccaaggtttccagaggaaggttcgtccgctctgggtaagtcgggacctaaggcgaggccgagaggcgtagtcgatggacaacaggtagagattcctgtacttacggtatgaatgatggagtgacggagaaggctagcggatcctgctgatggaaatgcaggtgcaagcgaggtagccgacagccaggcaaatccggctgtcgaaaggcaaaggcgtgaggcgtatggaaagctgcggcaagtacagaagtccgtgaagccagcttccaagaaaagcttctagtgataatcatacagtaacccgtaccgaaaatggacacacatgggtgaggagagaatcctaaggtgagcgagagaactatagctaaggaactctgcaaaatgactccgtaacttagggataaggagtgctcatagagatatgagccgcagtgaaacggcccaagcgactgtttaccaaaaacacagctctatgctaagtcgaaagacgacgtatatggggtgacgcctgcccggtgctggaaggttaagaggatgtgtcagcgcaagcgaagcattgaattgaagccccagtaaacggcggccgtaactataacggtcctaaggtagcgaaattccttgtcaggtaagttctgacccgcacgaaaggcgtaacgatttgggcgctgtctcagctgtagactcggtgaagtcttagtacctgtgaagatgcaggttacccgcgactagacggaaagaccccatggagctttactgtagcttgatattggactttgatgcaagatgtacaggataggtaggagactgagagacatgcacgccagtgtgtgaggagtcaatgttgggatactactcttcttgtattggagttctaaccggatgccatggaactggcaacgggacagtgtcaggtgggcagtttgactggggcggtcgcctcccaaagagtaacggaggcgcccaaagataccctcagcttggatggaaatcaagcgcagagtgcaaaggcataagggtgtttgactgcgagacctacaagtcgagcagggacgaaagtcgggcttagtgatccggcggtgctgaatggaaaggccgtcgctcaacggataaaaagctaccctggggataacaggctgatctcccccaagagttcacatcgacggggaggtttggcacctcgatgtcggctcatcgcatcctggagctgaagtcggttccaagggttgggctgttcgcccattaaagcggtacgcgagctgggttcagaacgtcgtgagacagttcggtccctatctgtcgtgggcgtaggaagtttgagaagatctgtcctcagtacgagaggaccgggatggacatatcaatggtgcaccagttgtcacgccagtggcacagctgggtagctaaatatggaagggataaacgctgaaggcatctaagtgtgaaacccacttcaagatgagacttcccattacgcaagtaagtaagaccccttaaagacgataaggttgataggtcaggagtgtaagcatggcgacatgttcagcggactgatactaataggtcgaggacttaacctagagaaaaagggttaaggcttgaaactgaaagaagacaaagtggaagacaaaagacgcaagaaaactattatctagttttgagtgattctcgaaaggaattgcttagaaaagaagatctggtagcgatagcatgatggacacacctgttcccataccgaacacagaagttaagcatcataacggcgaagatagtaccaaggtgcgacaatagcaagctgccggttctttttttatttacggatacctctgcgtatcctttttttattttatatccggctttaataatgaattctaagatgggaatatttagaaaaaaagaaggtcactttatttgaccttcgatttttatgttttatatttcaactgcttctttaactaatgcaactacttcttccatagttccacagttaatagctttagcagctaattcattcatttcagattttttcattgatctgattaactttctttgagaaagaatagatgtagcagacatagagaattcatctagtcctaaaccgattagtagtggtgcagcaattgcttctccagccatttctccacacatacctgtccatttaccttcggcatgggctgaatcaattacatgtttaactaaacgtaagattgatgggtggaatggttgatataaataagaaaccccagatgacattctatcagcagcaaatgtgtattgaactaaatcgtttgtaccaattgagaagaaatcaacttctttggcaaattgatcagctaacactgctgcagctggaatttcaatcatgatacctacttgtaatgtatcagatacttcgattccttcactaattaatttttctttttcttccattaagattcctttagcttttctaaattcatctaaagtagcaatcattgggaacataattcttaaatcaccatatactgaagctctaagtaatgctcttaattgaactctaaagatgtcttctctttggaaacataaacgaaccgctctaactcctaagaatggattcatctctttaggtaaatcaattgcttcgatttctttatctccaccaatatctaaagtacgaacaacagcaggttttccttctaatccttcaagaacctctttataaacattgaattgttcttcttcagttggtaattgagcagattccatatataagaattcagttctgaataacccaactccttcaccaccattgtctagtacaccttggatgtcttttggagatccaatattagcaactagttcgacgtgatgatcatctagagtaacagatttttcatttttcattttctttaattcttccttgtatgcgatgaatgcttcacgtttagcttgatattctttaatttcatcatcactaggattaataattacaataccagcttcaccatctaaaacaaccatatcagcatcattagtttcatcagttattgttttacaagaaacaaccgcaggaatttctaatgaacgcgccatgattgctgagtgagaagttctaccaccaatattagtagcaaatcctctaactaagtttttatttaattgcgcagtatcagatggagttaagtcatcagcaataataacaacttcttcatcgattaaagcaggatttggcaatgacttacctagtaagttagctaataaacgacgagatacgtccttgatatcagccgctctttctctaaaataatcatcatccatactttcaaacattgcaataaaagtattagcaacttcatctagagcagcatcagcgttaatcttttcatttctgattttatcctctacttgagtttttaattcaggatcttgtaatactaatgcatgagcatcaaatacagcagcttcttctgcagataaatttttagcagcagcttccttaattgattctaattcttttgcagtttgtgacattgcatcgtcaaattttttgatttctgcctcagcatcttctactgttacttttgtcactgttaaatccggcattactagtttgtatgctttagcaatcgcgataccactagatgccccaataccttttatcatattaaaaacacctccatatacattcctattttaccttatttttagcaaaaaataaagaaatatcgaactgtgactaggtattttcgcgttatgaaaaaagggctttcaaaagggacttacaaattaatagactttgacaaaaaatacatgactcgtttttttcgagttttgaaaaatgattgatatttccggcctttaacttgaagttttaaggtaaaaatagtatcatataagtggagggacacaaaatgaaattaattatagttgaaaattatgaagaagcaagcattgaagctgcaaaagttatgttagaagttgttaaaaacaatccaactgctaatttgggattggctacgggatctacaccaatcagaatgtatgaattgatgatcgaagatcacaagaagaacgggacttcttataaagatatcaaatcatttaacttagatgaatattttggattagaagctactcatccacaaagttatcattattttatgaataaacatttattctctggaattgacattaatcctgaaaatgtacatgtaccaaatggtgctggagatattcaagtaagttgtgatgattacaataaattattagctgaaaatcctatcgatatccaattgttaggaattggttcaaatggacatattggttttaatgaaccaggaacttcttttgattcagtaactcatatgattgaattaaaagaaagtacacgtcaagataatgcccgtttattctttgatgggaaaattgatgaagtacctactcatgcgattactatgggaattttaaatattttacaagctaaaaaagtattattagttgcgtgtggtgaaaataaagctcaaccaatcaaagtattggttgaaggtgaaaaaactacagacgtaccagcaagtgcacttcaagatcataatgatgttgttgtaattgttgataaagcagctgctagtttattaactaaataataaaaggaaagatttataaatctttccttttttaaaaccttttttttacctttaaagaaatgtgtttaatttgtttacgtaagataaataacgtataattattatatgggggtactaaatatgacaaaaaatttatttaaagaagtagcgatgaatgaaacaaatccaaactactcaaaagcaatatcaagacttgaaccattgtatcaaagaagtaatgatctacgtagtgagtttggtcgtgattatacgagaattatcttttctcaggcataccgacgtttaaaacataagacacaggtgttttttgcagttaaggatgatcatgtttgtacacgtagtgaacatgttaacttagttgaatctgtaagttatacaattgcaaattacttaggtttgaatactgaattaactaaagcaatagcagtaggccatgatttaggacatgccccatttggtcatggtggtgaacgtattattaacgagcttgctaaaatacatgggctcgattctttttggcatgagcgcaatagtcttcatctcattgatgaaatagaaacattagaagataatgaacatcatcgccataatttaaatttgacatatgctattcgtgatggaattatttctcattgtggagaaatgaatcaaatgagtattaaaaagcgagatgagtatattgatttacaaaattatactagcccaggacaatacagtccttatacttgggaaggatgtgttgtaaaaatggcagataagattgcctatttagcacgtgatattgaagacgctttacgtctcaaggtactaaaagagaataaagttgaagtcttgaaagcttcgctcaataatattactagtgaatatcattttacagcaatcaataatggaactgtcgttaattattttattcaagatgtatgcagtcatagtaatccaagcgatggaatttcattatcaaaagaagcttttgaaataatgaaaacaattatgaagtttaattatcaaaatatatatttaattgatagagtacaaattcatactaattatgttaaattgattttaaattctatttttgatttctttattaaatacgatttaatggctcgagatagtaatactaatattattgatgaaatttctaaggataaagatcaatttccccatgcaatcaatggatttatccattggcttgaaaaatatagtgtgatgaatggagcaaaacgtgattcgctttatcaaaataaagttatttatgattttattaatgatgataaagcaattattaaaagcattttagattatttatcaggaatgtcagatgcctatattattcaaatatttaatgagcttatttcattttaatccattgaagaaattcaatggatttattatttttacttaaattattagaatagatgtggtaaactaatcattattagggaggtttaaatatgcctattaaaataccaaatgatttaccagcaagtaaaatattaaaagaagaaaatatctttgtgatggatgaaaatcgtgctttagctcaacaaattaggccattgcaattattaattttaaatattatgccgactaaagtagtaactgaaacacagcttttaaggatgctgtcgaatacaccacttcaaatcgaggtagactggattcatatggccagtcatgaatctaaaaacacacctcaagaacacttattagctttttataagacatttgaggaaataaaagataataaatatgatggtttgattattactggagcaccggtggaaaaacttaggtttgaagatgttgattactggttagagatggaaaagattttagaatggtcaaaaactcatgtatttagctcattttttatttgttgggcttctcaagcagcattgcattatttttatggtattgagaaacatgaattaaaagaaaaactgacaggtgtttattttcatcatactaatgttgataaaatgaagcgaaagatacttagaggctttgattatcaattttatgctcctcattcacgttatacaacaattatggcagaagatatagcaacgatttctagtcttgatattttagctgctagcgatgaagcaggggtttatttgattgcagaaaaagatggctcacgtttttttgtaactggtcatcctgagtatgatcctgatacattagataaagaatataatcgtgatctggcaatttctgatcaagctactatgcctaaaaattattataaaaatgatgatatgcacaatgaaattttagtaaaatggcgttctcatgcttatttattatttagtaattggttaaattattacgtttatcaagaaactccatatgatttaaatgagttagaaagtttaaaactaggtaaataatgtaatattgtatttacgataagtttaaaagttgaagaaataaatcttgctcaaattaagtaaatcttctaagttggaccagcaaatgatatgtatcaagaattctagacacatatcatttttggtccaatttttagaatcggtacaatttgagtaatcagtaaatttatatataatttctaaataatgcagtagaattaagtttctatttcttttaagagtttactttgagtttgtctgtatcttagtggtgtaaggcccattgtttttttgaatattttatcaaaatattcaatattattaaagccacattcaaaagctatatttagaattgataattcagtagataaaaggagttctattgccttatctattttttttatttaaatattggctaggagtcatatttaaatattcatgaaattttttaattgtatattgtttagaatatggtgagatgataaaaatatcttttgtttctttaattttatttaaatcttgtatttctaataataatgatttaaaccaatttggatatatattcgtatcttttgattgatgatagattaattcttttatcatttgatataagaacaattctatatctttatttaactcataataagaatcgttgagattgatatcattatagtaattaattagttttctagatttttcatcagataagtgtcctattacagtatcattaattaaatgaaaacctccaaatatagtctgaactctattcataattttgtcagaaaaagctaaattgatatattttaaggaaatattttcattaatagtaacaagttcatgaaaaatattttttttcattaaaataatgttatttcataatatgtctgataatgttttcctacttcagatttttttctttttcggtgttgccagtgaatatctttgctgttattgatgatttctagacttagttcttgcataaagcacctccattatttttattatattataattttgatttaaataaaattaaaaataaagttagaaaaataagataaaatgaatgctttgtttaataaagtttaaaaagcgaatatatgttaagtatgatataccttgttatgatactctttatatgaaaaggaggtagacaaatgaatgaaattcaatatttaaaagagtttacgagattgtataaagaaaatagtcatgataaatacaatcgggaagtagaatgccatttctttatgcacaaggaaaatcgtacaaaaataacgagcgatgattatttcttatcatgttttcctagtgcaatttgtggttttggatcaagaaatactaactttatttacaattgcaaattagaacgattagcaaaattaatcgaaggtacacatgatgttgaaaaagaagaattagaagaattgtatacgttttgggctgatgagaatgataaagaacgtcttagaagatattatccaaatgatataaaagaattaatgccatatgatgattttgaaaatgattattatacagcgtatcctttatatagattaggaggagcttatcttgattttgaaaaattatttgatttaggaatagatggattgattcatgaaattgattctcaaccactcaatagttttttaagagcttgtaagaaatcgcttatttacttaaaagaattaataaaactgtatcgtgatgatgccatggacattaatcctgaattggcttatacgttaaatgaattacttgaacatagaccacaaaatatgaaagaagcgattcaattaatgtggatttatgtaggcgttagtgaaattagaaactatggaagaatggataatcaattagcacgttttttagatgatgaacaagatgcatataagaatattgcagaatatttcaaggtaattagacaacgaaatacgatttacaatggtcgtattattttaggtggagagggtcgtcatgatcttgaaaaagcaaacaagatatgcagtatagctcttaaagttatgaaagatttacatttaactgaaccacaattaacacttaggtggtcaaaagatatgcctgatagtatttttgataatgcgattgattgtatagaaagtggttgtagttatccattattatacaatgacacggttaatattaaaaatgtcaaagaatcaatgaatgtatcatataaagaagcagttgattatgttcctcttggttgtggtgaatatgttttggatcataaaagcattggttcacctaatggaatcattaatttagctaaggtattagaggggctggttaatgatggaaaatgtatgaatttagtagttggagcaactggcaaagacagaaataatactatcggaggacataaggcatgagtgctattattcatttaaagcattatatttcaaaaaagcatctacctacgtctttagagaaaaatgttcagtacagtttccttgtatatgaaagttaaaacgtaaagaactattaaaatatgtgtggtaatattgagtggtgcttttaattccctacttgccacatatccaacaaaatatttaggaatatctattgtggaatgtgttatttccaatacaatactattcgctaaaattgacatatcttcgtcaataatatgatattttaaagaaatatctggtatgttaaaatgttataaaataatagaaatatttttatactctgttggtgtcattccgtatgctttcttgaaattacgagaaaatatttcatggtatcatcatagaaaacgaggaatacagtataactgaaaacgctaatgttgtgttgacgaatgaaaatatcaagaaaatgctgaaaaaaatatcagtcaaataaataaagcaatataagcataacggttgacttattccaaaccaacaaaaaaagtgagtagcgtattagatatttttctcattaaatttagagttattgggagtgaatagatttctaggtttagtgatcgtgttttaacggtaagacggaaaccgttaatactattagaatttccaatatcaatatgtatacaatagtattctatgctatactaaaaatgtgaggaaggttaaaacaatgaaagaaaagattttaaagaattgtaaaaaatactggtatgttatagcatttatcattgtaggctttatcgttttaaataaagagccagattatcttgtattgaaaaaaaatacttttaaagttgaacttggtacaccattcaatataaaacctgaaacatatttaaatacagaaaaattagataccgatgtaaaaaaggatgtattggaaaacgcaaaggtaactgttgataaagatttgaataatattgaaaatttttgtttagatgttggaaaatataaagttaccgtttcatataaaaacgaaaaagaaacttttacttataaagttgaagatactaccgccccagtaattacaggtgcagaaagtattgatatagtacaaagtactgatttaagtacttatgattttaaagttctttatacaattgatgatttatctcaaacagatgttaagtatgatactagtgcaattgatgtaaatacaattggtgcttatactttaaaaattatttcagaagacaattatggaaataaatgtgataaagaagtagctataaatgttgttgctccattgagtgctgatgaagtaattgttgaggaaacagtatcaaacgctgatggtacaacaactacaaagattgtaactagaaagaaaaccgaagcacagagtggtgattttcgcatagttacttcgggtgatacatcaaaatcaagtaataatagttcttattcatcttctagtagttcatctaacagtatttcaactattaaaccaagtggtagtacatcatcaaatagttcatctaataataattctagtgctgctaagcctaataatggtaatttaataattgattaaaataaattaagcaattttttacagttgctttttttgttgaataaaaatgtaattcaaaatatttagctttatttgatagatcagtaaagtatcccaattacaggaatggaaaagaaaaatggtatttgaaatttgggtattggagagtattagatggtgcaaattcttggaactatagacttttttattgattagaacattcaaaatagtaagtggatttgacgctttggtgcccgaattttccatagtgaaataaaacgatatggacaaatataaagaaatgatagagaaattcgtattgagtgctataattttagcaaacaaatttgaagttgtggtgggatgggcagtatgggcggatttaaaccaactattggtaaatggtatgattataaaaactacgatatagatgagccacagtggagacgtcttttgaatactgctgaaaagcttgaaaatgaatttggagacttgtttgtatatgaaagagatgggtcgattggctacggtcttgagattatttccagtccaatgacaaaaggatattatgaaaaaatatcaataagtttaaaaacctgttaaatatttttaatgagtttcactatgtttctacaaaaggaaataaatgtggttcacacatttatttcaatagaaaaacactaggttttaattctaaagaatacagttctctattaagtaatcttaataataatataagaaaagcagaagaagtagaccacaaaagagcaaataaaaccattgaaaatgtggttgctgttatggaattatatcgagaagaattaatcaaaatcagtggacgaaataaaagcagtttacgctggtgtcagtttgaaacatcaaatggatatgatatagaagttataaaaaaagttgcaaaagataaaattaaaagcgatagaaatcgtcacaatagatacaaggttgttaatactacaaatgaaaaaactgttgagattagattatgtcgaggaacgctgttatgggaatcttttaatacacgtatcaatttaatgtataatattgtaaatgtatctagaaactatcaaggcttgattaatttggaaaaattaattgtatataaaaataatgataaaacaatacaaatgatgaaaaattatattgagaataatgatatagaaaatagaaaagttgatataaaggaagtgaaaaaaactatcattaatgcctaataatagtttaagaccatcaagttttatgtttggcaaataaatatagatagacgttaattaaaacaattaattcattttattgttttgattttttacatgaaataggttctagatgtctgggaacattgcttactcacccgaagaaaataaggaatgcattccttaattaaagaagaaagaggcaatgaatatgtgtataattattgtaaaaaatagcagaatggacttaccggataaagagattttaaaaagatgttggaataaaaatcctcatggtgcagggttcatgtacaattataatgatgtagttattattaaaaaaggttttatgtttttgatgatttttatgaaaatttgcaaataaatgataagctctataaattgaaaaatcaaagtgttgtatttcattttagaatatcaacaagtggtaaaattgatgagggaaattgtcatccatacccgctgactgatgacagtatataccttagaaaaacaaatttacgttgttctattggaattgcacacaatgggataattcaaaaatataaccgtaaagatagtgtgttaaatgatacataactgtttataaaaaacataatttatgatttgattacaaattaaaaagaaaattgatgaagagaaagttacagtttctaaatgcgaagagcagctgaagaaatcaaaaatcagcctatctaactttgaaaaggataaaaaggcactgctgagactaaagaaaaaagtagatgattttaatagaaaaatcagcgaaagtctatcggaatttgactgaatttaatgtctttgaacatttcaaaaaacaccctcaacttctgattatcatgcaacatatgaattttttgttattttgttataatgtttttattaatcatattattgtgctaaaattgataataacttgatacaatacaaacaaaaaagagtgtctattgaccatagatcactctaagagaccatctaattctaaaaagcagttagaatcgatgaacaatatatatatactatatattgattgatttatatatgttttaaaaaatataagttaaataataacttgtatttagtatatcatattaaaaaatcaattcaactataatagcatcgtttttaaacttcgctttagctagattaaatggttatatagaaacattttttggaataaccttttaactaactgttgttcgaagtgaaaaaaatggtgccggagctaagaatcgaacttaaatttcatgattaccattcatgcgttctgccattgaactacaccggcattggtgcagacagcgagatttgaactcgcacgagctattgctcactaccccctcaagatagcgcgtataccagtttcgccatgtctgcaagtattaatagtttatcaaattattgcagaaaaataaagcctagaacgtaaagttctagacttttttctttaatctgccttaatcaagttgtataaagcatgacaataaatttctgttgctttcaataacgaatcgattttgatattttcattattaccatgaattaaattatcttcacccaaaaattcagctccaaaagcaacacagtttggcattgacttagcataagtcccgccaccaattgcttgaggtttgttaactgtatctccagttacactaacataagcttcatgcaaattagtaattaacttagaattaggatcgatatatagagccttgcccaaatcatgagtttctctgaattcatagtttgcacaagcatgtttaaattttgtaaccattgcatcaaaatccatgtcatgagggcaacgtaagtcgagaacgattttaacttcttctttataataagatataactcctaaattaagagtaagaggacccattaaaccggtatggtcaattcctaattttttaccatgacagtcatctaaatattcaagaacaaaatcaacaactttgttatcaacgacagttgctaaatatttgcataaatatacaacagcattaatgccctcttcaggagtacttgcgtgtgctgatttccctttaagaattaatttagtatgatttccttcctcttcaatatccccagttaaattattagtatttaggaatttcttataagattcagtatattgtttgtaattcccttcaattactgcttcgcaagtttctggaacaatatttggacgacttcctgcacataaatagattaatccacctttttcaacatgtcctgtgatttcaaaaccacaacctgctttttcaccataaacaacaggaaaagcagcatcaggagtaaatcccattttaggataaggcatctttgtgaaataatattttacacaattactacctaattcttcattgcatccaaagataaccctagttttcatttttgtaggaatatttaaagaattaatgatctttgcagcataataaccagccattaatggtcctttatcatctgcgactccacgtccgtaaagctttccttctttagtaataacttcaaatggatcactatcccatccaaccttgtttacaggaactacatcaagatggcccaaaattccaaaagtttcatcaccagttccaatatcaatatgtccagcatgtccatcaacatcctgcacttcaaagccatcacgtcgaccaatttctaacattgcatctaaagctcggcgattggctgcgccatagggagcaaactcagcaacggtactatcatcttgagttgaagggatggcacataacatttttatatcatcaatcatttgatcttttatttttaaaacttccgctttaaaatcaatcatattatcacctcgtcatcaattataacactattagttataatatttaaacaattttagtaataatagtgttatgatatatataataatcggaggtatgacatgaataatgtaagatttcacataacagtcaaaggaattgtcgtattaaataaccagattcttttaatgaaacgaattcgaccatcaagtgatggtcttggttattgggagttaccaggtggtgggttggaatatggtgaaacacctaatcaagcattaatcagagaattacaagaggaaaccggattagatattatcataatcaaaccagcttatactttcactaaaattagaaaagattatcaaaccgtaggaatcggatatttgtgtattcccaagaatgatcatgtccgtttatcgcatgagcatagtgattatcgctttgtgagtatacaagaggcaaaagaactgttaaatccagaaatttataatgatataatttttacaattgaagaatattatcagaacgttcatgatatccagtgataatattttaaatttgattatagtcatccaaaataacggtcttgaaattcaagactttttcttttatcagttgatattttatttatttgaagtaaaataaggtagttgaaaacaaatagaattaaggagttattatgaacgaagaaattattgcaatagcatcaaaagaattagaaataactaaaaaacaaatcaatgctgttttatcattattagaacagggaaatactgtgccttttattgctcgttatcgtaaagaagcaacaggagggttagatgaagatcaaatcagaaatattgataaatattatcaatatcaagttagtttattaaaacgaaaagaagatgtaattcgtttaattgaagaaaaagggatgttaacagatcaactaagggctgatattttaaaagcaacaaagttaaatgaagtagaagacctttatcgtccttataaagaaaaaagaaaaacaaaggctactgaggctaaagctaaaggtttagaaccattaagtaagtggattttatcactgccaaggggagaacttaaagaagaagcaaaaaaatatttaaatgataaagttgagactgtagaagaagcaattcagggagctttagatattattgcagaagtaattagtgatgatattaaatatcgtaaatttgttaaagatataatatataaatctggtacgattgaaacaaaagtaaaaaagaagaatcctgatgaaaataaagtatatgaaatgtactatgattatcacgaacgagttaatcgaattgtatcacaccgtattttagcgattaatcgtgccgaaaatgaaaaagttattactgttaatattgttttagataaagaatttttaattcaatatattaatcgtggagtgactagaaatcgtaatagcagtgttaatgaatatttattgaaagctgtagaagacagtttaaatcgtttattattgccatcgattgaacgcgaagtgcgcaatgaattaactgaaaaagccagcgagcaggccttaaaagtattttcaatcaatttagaaaagttattaatgcaggcacctttaaaagataaaatggttttgggtctggatcctgcttatcggacaggatgtaaattagctgttgttgatcagaccggaaaagtattgaagattgataaagtatttattactattccaaaagataattatgataaagaaaaaagaattttattaaatttgattaaaaaatataaaattgaaattattgcgattggtaatggtactgcaagtcgtgaaagtgaagcttttatttctcaattaatcaaagataataatttagatgttgattatgcaattatttctgaagctggagcatcagtatattcagcaagtaaattagctaaagaggagtttccagattatcaggtagaagaaagatcagcggtttcaattgcacgacgtcttcaagatccattagcagaattagtaaagattgagccaaaagcaattagtgtcggacaatatcaacatgatattgctcaaaaacaattagaagaacaattagattttgttgttgaaaaagcggtaaataatgttggagttgatatcaatactgcttcagtatcattattacaatatgttgctgggttaaatagcggagtggccaaaaatattattaaatatcgtgatgaaaatggtaaatttacaaatcgtaaagaaattatgaatgttagtaaattaggtgcaaaaacatatcagcaggcaatcggatttttgcgaattcctggagctaatgatccatttgatgcaacagcaattcatccggaaaactatcaacaagcaaaaaaattacttaaattaatagatgctgatgctagtttattaggaacaaatgaaattgctgataaattatcaaatattaacaaagaggaagtaatgaatgaactaaatatcgacaattatacgttagatgatattattgatagttttataaagccaaatcgctcaccccgtgatgcatatgcaacaccattattaaagaaagatattttaaaaattgaagatttaaaacccggtatgcaactagaaggaacagttaggaatgttgttgattttggagcttttgtcgatattgggttaaaaaatgatggattagtccatatttcgaagatttctcatgaaagaattaagcatcctttggataaactaagtataggtgatattgttgaagtctatgtcattgatgtagatgtcaacaaacatcgtgttggattaagtatgattaaataaaggatgagttgatgaaaaagtttctagttggaatagttattataataattgccagtattggctttaatttaaaacctgataaaagagatcaagctgttgtggttcaagaagagcctgtagttaaaaaagaagaagttattacttataaagaactattagaatatcttgatatttttaaaacaggagatattattaatattgaaaatactaattatttaagttcatatgctattccaggaagatggaaacatactattttctatctaggaacatatcagcagtttagtcaggtttttacacctgaagataaatattatgaggaaattaataaacattataagaatcaagatgaggttttagtactcgacagtaattctacgggtgttaaaatacggacatttgatcaaatggctaatcttaaagaagaatcgtatttaaaagcactttccggctatcgttttaatgaggatgataattttattaagacatatttaagtcgggcgttagattatttgggaacaccgtatgattacagcatgacaacttatgatgataaagctttatattgtagtgaattagtttattatgcactactagctaataatatagaagtgactaaaacgagcagtattgtcgaacatgttgtaattaccccaacagatttaagtgattttttagaaacattagaagatattgaccatgtatatttgcttgaaaaagaagataattggataaatgatgcgataaatgactagtttttgctttattttacttgtattcctactttaatactagtattatataaacgaggtgaacatcatgaaaatttcaaccaaagggcgttatgcaattagagttatccttgatattgcgatgcacgatgatggtaaatatattccactgaaagatattgctaaaagacaagatctgacggttaagtatttagaacaaataatttcattactaaataaagcgggctatttacaaagtcttcgtggtaatgctggaggttatcgcttatcaaaaaaacctgaagaatgtataattggtgatattctaagaattacagaaggtgatttagctccaattccctgcttgaaagatgaaattaataattgcagtcgtgccaatgaatgtattacattaccgttttggcaaggattagataaagtgattaaagactatgttgaaagtgtaactattcaagatttaatcgatcatgcaaatatgcaagtgaataattattcaatataaaaagccgtaaggcttttttattatataactattgacataaatttgctctcaaggtataatcatattaatccgataggaaaagagggaactataatgaatgagctaattttttataaaaatagaggctgttgttaataatagatttgattagataaagaaaatggaggaaatagtaatgacttataataatcatattagtgaattagtaggaaataccccaattttaaaattaaacaattatgttacaaaaaatcaattaaaagcaaatatttttgctaaactagaatattttaatcccgcaggaagtgttaaggatcgaattgctaaagccatgttatttaaagctaaagaagatggaattttaaaaccggattctgtaatcattgaaccaacgagcggtaatactggaattggattagcttctctaggaacatccttaggacaccaagtaattttaactatgccagagacaatgtcgattgaacggcgaaatttattaaaagcctatggagctaaagtagttttaactccaggaggactaggcatgaagggagcaattgccaaagcagaagaattggccaaagaatacaaaaatgcgtttattcctagtcaatttgaaaatcaagcaaatccaaatgcacattatctaacaacaggtcctgaaatctaccagcagctagaaggtaagatagatatctttgtcgctggtgttggaactggaggaacaattagtggaattggaaaatatttaaaagaaaaaaatcctagtattaaggttgtagcaattgaacctgctgcctcaccagttttatctaaaggaactccaggaccacatgcaattcaagggattggtgcaggttttgttcctaataccttaaatactgatatttatgatgaaattattacaattgaaaatgaagcagcctttgctactagccgtgcaattgctagagaagaaggagtgttagtaggtatttcttctggtgcagcactttatggagcaacagtattagcgaaaagaattgaaaatgctggcaaaaacattgttgtgttgttaccagatactggtgaacgctatttatcaactgcattagttgaacaagattaataatatggatactgtctttagggacagtatctttttctaactacaaaaataatttttaattataattatattttaaaagtctatcataaaaatatgagtgtttgttatgcaactaggataaacaactaataatttaaagtttaataatgagattcactatttaaaaatataaatagacgggaagaagagcagagaaagatgattagttgtaatgaggtgattgtagtcaatatcaatattagccaaaaagattgtccaaaatatctttaaattatggacaatcttttttttgttatagtatacaaaaaagtacttggaatatttgtaattgatatcttaataaacagaaattatatcattgaggtgatatgataagttgtcttgtatggacgagcttaaacaaaaaagttcagttaaaatcctgttgatttgaaaaagtaattagtacagttaaaaagaataaatcaaaattaaagttatagaggataatgtattggttattataataataagatatcattctacattctcactggacatttaggaaaataaaaaacatagtctgaagagcattgtgtaaaatacttttaatgctactcaattgctatgccttttattcaaataatgttgttgataagtaacgttctccagtatctggcagtagaacaacgatgtttttatttttatctgttattttagttgctccatgcagggcagctccagcagttattccaactagtaggccttctttttttgctaatattcgtgcagcctcataagcatcatccgtagaaactgttatcacttcgtcgactagatccaaatcgagaattttaggaataaaatttgctccaattccttgcaaatcatgcgctccagcttttcctttagtgattaatggagaatcttttggttcgattccaataattttaatatcaggatatttcttttttaatatccgagcaattcctgtaattgtccctccagtaccaattccggcaacaaaatagtcaatattatcatcaaaatcatcaataatttctaatgccgttgtttcttcatgggctaagggattacttggattaacaaattgacctggaatatagctattttcaatcttattagcaagttcgttagctttatcgactgatccttgcattcctttttctccagccgttaatacgattttagctccgtaagcttttaataatttttgacgttctaatgacatagtttcaggcatcgtcaaaattaattcattaccatagatagcacacgcaattgctagaccaatgccagtattaccactagtaggttcaataatcgtagtttttttattgattagttgatcctcataagcctgttcaattaatttaagaccaacacgatctttaacactgccaccaggattaaagaattctactttggcaaatattttgttgtttacttcacatgcttttttaaagcggtcaatttgaattaatggagtttttccaattgtatccaaaacactttttttaatagtcatattaaattcacatcctttttctttttatatcacatattgaagtgtaagtgatataaaaattataattttatttagttgtctttattaaaatagtaatttataatacttttaaaggggactgtttatgaaggattataaatatttagaagtttatcaaactattgttgatgatattgaaaatggttatttaaaatataatgataaaataccatcaattcgtaaaatggcaaaacaattagatgtaagcagaactacggttgaaagtgcatatttacaattattagtcgagggttatatttacgcaaaagaaaaagtaggatattatgtggatgtgcaatttagtaatcaaattaaaaataaaaagaatccaaaagtaattacaaaaattgatagtcaccattatcgatatgattttagtggacgtcttgttgatgtggaaagctttaatttagatacttggaaaaagtatattaaaaaagcattaaatcaaagtgaagatttaatgagttatggagaaccattaggggaaatgcctttaagagtagctttgcaggaatatagccatgaataccgtggagttcggcatcctgtaaataattatattattggtgcgggatttcaaattcttctttatcatgtttgtagtctttttggtaaagataatatagtcggaattgaggaaggaggattcaaacaggcagaggccgtttttcatgattgtcatatgcaggtagttaagttaccggttgatgaagaaggcattactttagagggattaagacaagctaatttaaaattattatatttaaatagttcttctggagggtatcatggtcatcctatcaaacaacagcgtcgtttagaaatcattgaatatgcgagagctaatcaagtctatattattgaagatgatcataatggagaattgaaatttaacactaaaccaatcgatgcaatgtcaaaactagacaatgaccacattatttacattggttcattttcaaaattattactaccttcaataagaattagttatatggcattaccaaaccaattagttcagttattttatgaaaagtctcgagattatcatcagactgcatcaaaattagaacagctggctttagctatgtatgttgaagatggacagttagcacgacatttaaagcgattaagaaaacattaccgcaataaaagtactcatttgttacaaaagcttcgaactacttttcctcaacataaattcgaattatatgaaacctcattaaaaatcacaatggcaattaaggctgatttggttgatcaatatattgctttagcaaaacaaaatgatattttagttaataaaaatagtaataatcagattactttatctttttcaggaatcttagatcaagatattgatgaagcagttgatagattaaaagaaatttggataaattaaaaacagtgcattgcactgtttatttattaagatgtttacagctgtaataagcaggaataccgtttaaataattaatatgtacttcaccttgaattaacggatacaagtaatcatataattcttgggtaatatcatttccagcttcattaatccaggcagttggaattttttgttctaagttagctacttttcttacatcagttgaaatataatcaatttcataaggggtatttgaaattcgtttaaatcccattacttggccggattttccagttaacgcagtttctattgctttttgtccaactacaaatgactcatttaaatctgttttactcccaatatgcatagcacatcgttgtaagacgtttaattcaatacttctaactttacattgaaattctttgaaaactaatgattctagcatttttccagttcctgaatgaagtacatgaccaaaagcgtcttttttagcatatttagaatcatcatcgaggaagtgaccatctttatctttgataccttcgcttacagcaattacaacacagcgtttacgtttaaatacttctcgaatatcttctaagaatttttctttatcaaaaactacttcaggtagataaattaaatcaggggcttcattatattcattacgagccagtgcagcagctgctgtgagccatccggcatttcttcccataatttcaataattgttactgattgcagctgatagattaaactatcatgaactacttctaagattgaagaagctacatatttggcagctgaaccaaagcctggggtatgatcagtacccattaaatcattgtcaattgttttaggaataccgataaattgaatttcactattgattgattttgcgtaatcatctagtttcatgacagtatccattgaatcattaccaccaatataataaaaatcagtaatttctaattcagttaaaatttcaaataattttacatatgtttcttggttgtcaatatgtgttggtaatttaaaacggcatgaaccaagatacatagctggtgtttgttttaaagcattaattttttcacctgtatcaaattcctcaagcaggtccatataacgaccttctaataaacctttaatcccgttgatcattccataaacattttcatattcttcgctatgtttagctttatgaatgattccagcaagacttgcattaattgcgattgtgggtcctccagattgtccaataatacaatttctttttttcatcttattctcctttttcctgcctaattctatcatttttagacagtaaaaaaaagacatattaagtgattaacgtctttttcttaaaataatgtaaagaattataattagtgcaacaaagataaaaatatttgcaggctgagtcgtttgatgccgattactagaaatgattgaaattgacttcgtttcatcctgagttaaaaaatctaatagattaatcttgacttgattatcctggatctttccataactagtttcgctaatatttcccggcattttaatatttaaatttagctcgagtcccatagtcttcaaatttgttagagaataattattaatatcttcaatttcacttgtattaaaaatattgttaatagtactgtgatcaatcgtaacttgataagttccttcttttttatttgtagtgaagaaactcaataagcttttattaatatcttttggtgcaataagctgaaatcctatatattgggtaccattaatatctttttttagttctttattttcccacgtactcaactcactattagttaatttatgttttaaatcagtaagtgaggtaccataagaatctaataaatcttcttgaatgagtacttcaattgttaaagatgcattactttcatcaataaattcgatgtcaacatttccttttacgcagcctgttaatgataacaacatgatacctaccaaaaataatttttttaccatcatctacctcctaatgttagtgtgccacaatcttcattttctaaaattaaaaagtggatttaaaattgttaaatgatataatttaatcatggttaacatatagttcacaaaaacactttaaaatatagaaggtgatataaatgagagtagaaattctatatacaagtaaatcaaaacacatcaagcctgttgctgaagctatggcaagatgggttaaaacatatgcaaagacgattgatcaatttgatgctcttgctccagtcgatttattagttattggctttgatgattcggcttggaaagatccgcagttagagacatttattaaaagtttaaatagacaaaaagtacataatattgctttgtttaatgctttctacattaatgatcataaaatgaaaaatatgattaaattatgtcaagaaacagatttaccacttatgcgtgagcaatattcatttaagcttacatttaggcagttaaaggaaattgatcaatgtgtaatagatgctgctcgtttatatgtagaagatatggtgaacttggtaagggattattattaaattagtaaatttatactaataacaaattattaaaagctatcttaggatagctttttctttttattataaagaatttaaggaaatttattaatattttaattaaattataatttgttaaaatcctaaatttaataaaaatatatatttataaaaatattaattgacaataatttattattctgatagtatttttttaagatttaaaggcgataaactttaaatcaaaaaataaagggggaattttaagtatgaaaaaactagaaatcattatcagacctgagaagctagaaattttaaaagatattctaactgattgtgggattaccggaatgatggtttcaaatattatgggttttggtaatcaaatgggctatactcaacaatatcggggaactaaatattcggtaaacttagtttctaagttacggattgaaacagttgttaaagatgaagtagttgatcaaatgattaaagaaattacaaccaaactttcatctggtaatgtgggtgatggtaaagtatttgtttatccagtagaacaggcagtacgaattcgaactggtgaaacaggagaaaatgctctgtaacagatttataaaaattaaaagggggatcaaatatggaacaattaattaatattgtttgggtgtttcttggtgcggtaatggttatgctgatgcaagctggttttgctattttggaagctggcttaactcggcaaaaaaactgcaacaatgttttaatgaaaaatattatggattttgcaattggatcaattatatttttagtagtaggttttggtttgatgttcggcgaatcattagggggaattgtaggtataacaggattcattgatccgacgacattaaatttatcacagtttgaggcactttcaccaacagtatttatcttttttcaaacagtcttttgtgctacggcagcaacaattgtttctggtgcgatggcagaaagaactaaattttcatcatatttaatttatacgttagtaattagtttagtaatttacccaatctctggtcattggatctggggtggaggttttttatcaaaaataggatttattgattatgctggttctactgctgttcactcagttggtggttgggccgcattaatgggggcagttgttttaggtccacgaatgggaaaatataatagggatggcagtactaatgcaattcctggtcataatatcatgatggccactttaggcgtatttattttatggttttgctggtttggatttaatccaggttcttctttagaagcagcaggttatataggtcatattgcgatgacaacaaacttatcagcatgtgctggtgcattagtagcaatgtttcttacttggaaaaaatatggaaaaccagatgtttcaatgactttaaatggtattttagctggtttagtagcgattacggctggttgtcatattgtttcattatatggtgcaattgcaattggagctgttggcgggattttagtagtttatggctgtgaaatcttagatcaaaaattacatgttgatgatcctgttggggcagttggggtacattgtttaaatggtgtctggggaacacttgcagttggattatttgcatgcaataccccagcaagtgaaggaactttaggcttattctttgggggtggaactgctttactgattacgcaattgattggtgtaattattgtagcagtttgggtatgttcaatgtccttcatcatgtttactttaattaagaaaacggttagggttgcgagtaacacctcaggaagaacttgctggtcttgatttaggagaacatggttctgaggcatatcctgattttcttaaaaaataatttatcgtaaggttgggagaccaacctttttatatggaaaaaaagctcaaggtgtgatacaattttatcaattttaggaggagatactatggataataaaaactatggttttgaaacattacaaatccatgctggtcaaaagccagatgtgacaactaaggctacggggatgcctttatatttatcaaatgcttttacatttgaagatgctgatcaagcggcgcgaatttttgcgttagaggaaggaggatacttctattctcgattatctaatccaacagttgatgctctacaacaaagaatggcggctttagatggcggattcggggctgtagcatttgcttctggaactgcagcaattatgggattgattatgactgtgtgtgaaactggagatgaaattgttgctgcaaataatttgtatggtggtacgattggttctttatcaggaacgatggcaggaatgggatttaagacacactttattaatccaactgatttagaggctttaaaagcggcaatcaacgataaaacaaaaattatttttgttgaatcggtaggaaatcctaatggagatatgttagactttgaagcaattagtgctattgctaaagaatatcaaattttatttgttgttgataacacaacaccaaccccttatttatttaaaccaattgaatatggagctgacttagtagtctattcaactactaaatatctagctggtcatggtaatgttatgggtggtgtgatcgttgatagtgggaactttaaatggaaagataatcctcgctatccattatttaacatgcctgacaaagcttatcatgatatagtttatgctgatttaggagcgggtgctttttgtactaaagcagtagcaaagacattacgtgatttaggagggtgtatgtcaccgtttaatgcgtatatgactttattaggattagaaacattatcattaagaatgaaaaaacacgttgaaaatgcccgattattagcaaaatttttaaatgagtgtgatgatgttgaatgggttagttacgcggaattaccagatagtcctaactatgaactagctaaaaaatatttccccaatggttttggtggattatatacttttggagtcaaaggtggtgttgctggtggtaaaacagtaattaataatattaaattatttattcatgttactaattttgctgattcacgttcattgctgactcatcctgcaagtacgacacatgctcaaatgtcagaggaagagagaatagcaggtggggtaaaacaagaaacaattagaatgtctgttggtcttgaagatgttgaagatttaattgcggatttaaaacaagcatttgctaaaatataaaataattaggactattgtttattgttcaaaacaatagccttttttctagtttttttattagtcctcatgtataattttaatgaggtgattaaatgcagagttttttagccatgcatattaataatatagttatgatcctgctgctttttatctatgtagtctgtttaaatggactattttcaatgcgacgtcgtcttataaaatggcgccgtttctttgcgttcttatttattattagtaccgcgggtttaatgttaggaaccattcgtaatgagctgatggtttattggtttaataatgctagttttaatattgagagcaattttgaatggatgattaagataggttatgatctgattagtttaattattatgattttaatgatttttttggtgaaaaatattttagattttattaaaaatagtagtcgtgatgcaattcgtaaattagctattaatgccgatattatagctatcttaattattattagaactgtaatcgttccgctgattgttaaactagctagagtattggaattatttggattaaataatcaaactagcagctctaatgatatatttctttatgctttgccatacttgggattaccggaggttgcaattattgttgttacaatctttatcaatatactaggaataagttattggaatcgagatgctgaagatgttatggcaaaataaaagttatgatctagttagttatctcgaaataataataggtattattgccttgatttgtttgctatcattactttatttgtggtaccaacccaaatgtcaaaacaagtttaataatattgtttttttaggacacttgataatttgttttgatctttatttattagtagataaagttgcccatttattaatgagcttttatcaggcttatctgcatcatctaaaatacaatatttacgattatgcattattaagcagtgatattttattaacagtggttttaatttttagtacttttttgtttatcaataatctagaacatttattaataaagaaagatagtaaagaagagtataatttaattttaaatcgagtttttaaggcctataattgtttgatggtagtatttatttttaaagatgttgtattaaaaattgtatatgatttcttggtagatgttagaggaattaggttacattatcacccttatacgattaataatttaatggttacaatcgtattaatgttgttattaggcttggtaataaatttttataagaaaaaaacgacttgatctgcagcacttcttaaagttagagtaactttttgaagacactacaaatagtcgtttttttaatcaataaccatagcattaggaataggtgctaaaggattttctttgttgatacggtcatagaacaaagttccctcgaagtgatctagttcatgttgtaaacaaattgataagaatcctcgagcaacaattttcacttcttgatcagtcaaaacatcatatcctttaacggtcaccttagcgtagcgtggtacatatccttgaacttcatcattaacagataaacatccttcaccatcttttaaataagattgtttttcggtatgtgaaatgatttttgggttaactaaagcatagtcatcagccccaataacatttccatcttcatcaaaatctaaaacatgaatagcagtcattcgtttaggaattcctaattgaatagccgcaattcctacagctgggcgtaaatcatatttttcagaagtttcagggtcttgagagttaacaagaaactcatgcatttgtaataaaagttcgcgttcttcatttgtgattggtaatgctacttcttttgagacctcacgaatcttttcattatggtcatcaattatatctttcattgttatcataggttcacctcattttaattctgatagtattatatcataaaatgaggtgaaataaagactttatccgactctaattcttgaatttccacaaatgattaataataagaatacaactaagacaatggcaaaccagtttgaagaaccgaaaccaccgcaaccacaaccgcatccattgcttgaaatgttacagctgttgcatccaccacatccaaatggattagtgataaaaggattgtatgaattacatccacatccagaatagttaaatccgcagttcatattatcgcctcctttagtatatcctattctaatatttatcttttgtttgggttattgtagataatcgataaattttaagttataatataaagcaattaaggagtgtgttagtatggattacaattatccgttagactatagatggtcaacagaagaaataattgatgtaatggcattatataatgctgttgaaaaagcttatgaagaaggtattagcaaagaagaatttatgcaggcatatcgtaagtttaaagcaattgttgatagtaaaagtgaagaaaagcaattggacaaacaattttacgaaatttctcattattctatatatcaagttgttaaagcagccaaaaataatgattttattcgagtaggtgaataaattggcaggaatagaaaagattaagcgattatttaaaagtcgtggggtcgataaaggtatttatgctagtgtttttgttttggcaatttttggaataattatgattggttcagcatcagttggaagtgtgacttctcatggggttacttatgctttaaaaaatatgattactcaaagtgtttatgtaattgctggggctggggtaatgatttttattgccagagtatttaaaactcggtatattacttatagtgcatcgatgaaattatacttattaggaatctttttaatgataatctgtatattttttggtagtactaaaggctctcatgcatggattaaatttggttctttatttagtattcagccagctgagttcatgaaagttgcaatgatactgataatgagttattttttaactgaaagtgataaagcctttgtagtaaaaggtagatttaaaacacaacagctgaaatctgctttttataaagaaaagtttttaaaatgtgttttcctgccaatgatgttagtagcaattgctgctggagttgggatctttgtgcaaaaagattttggaacaactgttattttagtaactatttgttttgtttgttttattgggacaccgcgtcaatactttaagaaatacaagcgaatcgtatgggtgttcattggggtttgtggagtattgtttttaattattgggacttcagtattaaaaggttaccaattagggagaatttctacatggttagcaccattaagtgatccttatgatacaagtatgcaattatcaaatgctttaattgcttttaataatggtggtctttttggtgttggtttaggaaattcaacccaaaaatttggatatattccagagtcacaaaacgattttattggtgctattatatatgaagaattaggtatcattggtttaggcttaataattattccaacatgtatcattatttttaagttattaaaatattcacaagaaattaaagaaaataaatcacggattattttgttgggaattgcttcatatttctttttacatttattgattaaccttggtggaatatctggattaattcctatgaccggagtaccattactgttaatttctgctggtggatcttcatcagttactgcatttgtagcagttggtgtcgcacaagcaataattgcaaaacataatcgtcaaaaatttgacaccgattaggctaatatacatataatatattaggtgatcttatggatgaatttaaagagttcttaaaaacaatccctagtataaaacaagatgttcttaatggacgttatacttggcaacagttatatgaaatttttgttatgtatggtaaagatgataaattttggttaccatataaaacaggtaatagtggttttgatttaaatatgttactagaagtaattaagaatattgatttaaatgctttatcgagtagtttaggttcaattgaaaaagttttaaatgttgctagtacttttttagataaaaaagagcctgctaaggaaagaaaatggtatgatgaatgaagaaattagatattatcttcgttatcatcctaattggtatatagttttatctcggtatcctcaagaatacgagcatttaattcaagaatataaagatggtaaaaatcaacaatttattgacaagattgatcaagtatccatgttaattaatatggtagaaatgatgatgtaggtaagatggaagagatattagataaattaattacagaaataaaactggatcagcgatatattgattatgttgaagctgaaaagaaacttcataatcaggagattgattcattattgcatgaatatcaaaataaactgaatcaatatgatgaattaaagaaatataatcaatatattgataatcaggagattaaagatgaaattcgtgatttaaagaagaaaattgcaagtaatgaagatattttagattattattgtaagtatcatcgtttaaatgattttttagatgaaataactaaagtagtatttgggggtatttctaatgagttagatttatcaccatatcaattataagagggcttatgagagtaattgcaggtaagtataaaagtagacagttaaaaagtgttaaatcaaatttgacaagaccgacaacagatcgtaataaagaaaatctgtttaatatcattggaccatactttgatggtggagcagtactggatttatttgctggtagtggtggtctaggtattgaagcattatcaagagggtatgaacatttgtatagtgttgataaccagtatgcagcatttcaagtaattaaagaaaattttacaatgttgaaattagctaatgctcatgtatataaattagattatcgtaaagcattaaaacgatttgctaatgaaaaacttaaatttgatttaattttattagatcctccttatggaaaaggattagtagatgatatattagaatttctaattgtaaatgaaatgttaaatgatgaatgtatgatagtagtagaagagttaaaggaagtagaatttaaaccatttaaagaattagatttgatcaaaaaaaatgattatggcattacagctttaaatgtatttaaatttatggcaggataggacgatgaagaaaaatattgcggtttatgcaggaacatttgatcctgtaacaaatggacatttagatattattgaacgagcaagcagaatgtttgatactttatatgtaacgatttgtattaatcctaataaacaaggactcttttcaattgatgaaagaaaagaattattaaaggcggcatgtcaacagtttgataatgtgatcattgattcttctgataaattatcagttgaatatgctaaagatgttggttctcgaattattgttcgaggaattagagcaactatggattttgaatacgaattacaacttgctttttctaatcaatatttagataaagaagtagatatggtctttttaatgacaaaaccatcacattcatttatatcttcttcggcagttaaagaaatggtgagccataaccgcagtgttgcagggctagtaccaccatgtgttgaatcagctttacgaaagaaatatcaaggggaataaatatttccctttttatatggtaaaataattgtcaaaataacctatttttgttatgatgtaaaaagaaaaaaaactatgtcaactgggtataattaatattatttcccaattatacctcgttagaggtattttttatggaggaagattatgaacatatttacattaaaagatttttcaacagaagaaattaatcagattttggatgaagctgaagagtttaaaaacggtaaaaaagttgatttcaaaggacaaaaagtagttgcaaacttattttttgaaccatcaacaagaacgcattatagtttcgataaagctgcttataatttaggttgtcgaactcaaaattttgaagcagcaaattcaagcgttcaaaaaggagaaactttatatgatacggttaagttttttgaatcaattgggtgtgatgctgtcgtaattcgccatcccaaggaaaactattatgaggatttaattgaaagaattaagattcctgttgtcagtggtggtgatggaactgggaatcatccaagtcaatctcttttagatttaatgacaattcgtgaagaattcggtcattttgaagggttgaagattgtaatcgttggggatatcgttcactctcgagtcgctcatagtaattatgagataatgcagcgtttaggaatggaagtatatactagtggaccacgtgaatttgaagaagctggatataactatgttgattttgacaaaattttaccagaagttgacattgtgatgttattacgagtacaacatgaacgtcatcatgatttgatgcgattaacgactgatgaatatcatcagatgtttggcttgaatcaaaaacgtgttgataaaatgaaagaaggggcgattataatgcatccagcaccatttaaccgtaatgttgaaatagctgatgaaattgttgaatgtgcacaaagccgtatttttagacaaatggaaaatggtgtatttgtaagaatggcattattaaatcgggtgttaacaaatgactaaaatattattcaaaaatggtaatgtattttatcataataaactccaaaaattagatgttttgattgaaaatgatcgtattgcagcaatcgctcaagaattaacggatgctgatgagattattgatttaaaaggtaacttattaacacctggatttgttgatattcatgttcatttaagagagcctggatttgaacacaaagaaactattgcaaccgggactaattctgctaaatacggtggttatactcatctagttgcaatggctaatacaatcccatgtatggatgatgtagccacaattaaagattttgctttgcgggtagcaaaagatgcgaaggtacatacttatacatatagtgcaattacgactgaattaagaggtcaagaactagtagattttgatgctaatagtaaagaagaaattgtagttggtttttcagatgatggtcgtggagttcaatcatctatgatgatggaaacggcaatgaaagctgcaaaagcgaataatagtattattgtagctcattgtgaagacgaagctgaattacagccaggtgcttgtatcaacgatggtaattatgcaaaagaacataatttagttggaataaataatgcatctgaatttaatcatgctgttcgtgatttaaagttggcaagtgaaatcggaaatcgttatcatatttgtcatatatcaactaaagaaacagtagcggcattaaccgaagctcggaaaacaaatccattagttagcggtgaagcatgtccacaccatttaattttaactgatgataatattaaggatatgaatcccaattataaaatgaatccaccgcttcgaagtaaagaagatttagcggcattgattcaaggaatcaataatgggggtgtaactgtaatttctactgatcatgcaccacatgcgattgaagaaaaaaataaaccaatcgacaaagctccatttggaattattgggaatcaacatgcatttagcttaatgtatacatatttagttaaaaaaggacttatttctttagaaaaagttttgacatgtatgtctataaatccagcaaaggtaattggaatcgagcatgatctagaagttgggttaaaggcaaatcttgctgtttttgatttagaagaagaatatgtaattacaaaagaaagtattaaatcaaaatcaattaatacaccatttcttgaaactaagtgttttggagcattaaagtatcatgttttagatggtaaagttacaaaaatataggaggcattatggcaaacttacatgggatgatgaagattacaagcattaaaaatattgcagatgatgtatatgaaatgattttagaaggtgaaggagctaaatatatcagtgctccgggccaatttatcaatattaaaatcaatgatagtttacaaccttatttaagaagaccgatgtcaatcagtgattatgatgatagtcatattgtgattgtttttaaagtagttggagaaggaactaaaatcttaaaaaataaagaaatcggcagctatttagattgtttgattgggttaggtaatggatttaccattaaggatggtaaagctttattgattggtggtggattaggaacaccacccctatataatttaggtaaaaagcttgcagccaaaggaatagagataacgacagtactaggttttggcagtgcaaaagatgttttttatcaagaaaaatttgctgaattttctaatgtttttgtcgcaacaatggatggcagcaccggaacaaaaggaacggttgttgatgtaattaaaaatgaaggtttgacttttgataattattatacttgtggaccagaaccaatgctagatgctttagcacttaattatccagaaaatgggcaattatcatttgaagctcggatgggatgtggctttggtgcctgcatgggatgctcttgcaaagttaaaactagaccatataaaagaatctgcgttgaaggaccaatcttagaaagtaacgaggtgattgtaaatggctaatttaaaagtatctttacctggtttagaaatgaaaaatcccattattccagcgagtggaacatttgggtttggatatgagttcgcaaagttttatgatatcaatattcttggttcaatgatgcttaaaggaactacgttagaacctcgctatgggaaccctctacctcgaattgctgaaggaccaagtggtttgttaaatgcaattggtttgcaaaatcctggtgttgatgctgttatggctgaggaattagaaaaactaagaccgctatataatgataaagtaattgctaatattggtggtagtgcacctgatgattatgtcgaaactgctaaaaggatttctactcatgacatggtaggagccttagaattgaatatttcatgcccgaatgtccatagtggtggaattcaatttggaactaatccagaaatggcagctgatttaacacgtcgagttaaggaagtttctaaagttccagtttatgttaaattatcaccaaatgttactgatattgtagcaatggctaaagcagttgaagcggctggggctgatggtataacgatgattaatactttagtagggatgcgctttgattttaaaacaggaaaaccaattattgctaataagacgggaggatattcgggacccgcaattttcccggttgctctaagaatggtttatcaagtaagtcaagcagtaaagataccagtaattggtatgggcgggattcaaaatgcccgtgatgttatcgaaatgatgtcggctggtgcaagtgctgttgcaattggttgtcagaatttaattgatccatatgtatgtgaaaaaattattaatgatttagaaccattattagaacaaattggtattaatgatataaatgatttagttggacgttcacataaattttaataaaaatactagagtttattttaatacaaactctagtatttttatttattgtatcgtttttcttttttatcgagtattactaaactaaataaggcagtttttagtaaatttaaatataataaattattgctatctctaattttagcagttatttattccaaatcaaatggttttatagtagaagtttcatttttagtatgaatatagttattagggtcaacgttttcataattataaatcaaatcattaagattatttaaataatattttctgattaatataatggtttgtttatatatgcttgcacttaattaaattgtatagcctattattgaggtttacaagatgataaattatattcaatatttgaaaaatgagccaagtattgaacatagaaaaaacctcactaaacatagtgagattttttgagtgttttagttatgtcttttcttttttaatactaatggtaatactaacgcacccataataaataatgaagtgtatagagcgatatttgtattatcactagttttgacgttaccttgtttaacatcgtcttttttattagcatctggagtgttaggtgtagttggctctgctggagtaactttaactaaattattgatggcattttgtaagttgtcatatgcggtttcaatttcggtaacagtggcaacttcattggctgcaacagcttttacatcaataagaatattagctaatgctgcccagctttcactagtgtattctgcactattcaatgattcagctttattaattaattcgttaagggcatctttatttggttttagtcttagctgtaagaaggctcttactaatttatcgtgcgcttcttgaacttctggttctaaagcattttgattattaacaacaactttagcttcatctaaaacaggtaacattgcattccaagtgcttgttagataatcttcagcatttagtttagcaatttttttaattaaattttctaaattagttttatcaccttttttgaaagataatttttgcattacgtcacttaaacggtcaaacgatgcatttacttcttcttgcgtagctaaagaagttccattgatctgttgagcttctgctagagcggctttaaattctgtaactacagcaggaacaatagtatttaattctgcttcagtaactttaagtgcttcctcaattgcaatatttaaaagattctttttaactactacgtactcaacattttcgtaattataaatcaaatcattgataatatctgtgtagaaactatctttttgataattagcagggtttgctttaacatcactgatcatagcatttaaattatcaatattttcttgaactgcagtatttgttgtagttttgtcagccagagcggtttcgattttatttattactagatctagatcagtcttgttgtagttgatttttgattgtgtaaataaatcatcacgtggtgatccaagtgtatacatcagtctttcaaagctttcgtaatccatttccttttgatattctgctccccatgtttttaatgcaaatccagcataacgtgggaatagtgtcctagtcaaaatatattctggtacatacccgtgggcatcatcccaaattgggaatacttgtcctaatgacttgtcaagattttctgttaatacttcatcatttccataatgatatgatgattttgaataatgatatcttgtaaattcttcatatgtccgttttggtaatggacggtctagtttgctctgtccttgttgtggccataaatcatgatagtttgatgaagaacttgacatgattgtatatccagcattagctgtagtactggctttgattgatccgtacattcctccagcccagaaatcaacaattagacggctgtctaatggtactattcctcctaaatcaaagatgttgtcattccatactagtacttttaagttttgtttgattagttcgtctcccgcttcattgaagaaaagtttgatagcatcatggtctgtcgcagcttcatttcctgtcacttgacgtgcccattcctgtaaaactgttttaccggcagttgtataaccactttggaaatattcatcaccaccgatatgaatcgttttagcatggaagaaatctgctgcttctttataaacagagatcatatattcacgaacttcctgtttagaaaagtctaatgctttggttgaaccaggaatgcaccatccgctatggaaatttgcttcttgttcagcgtgacctgggaagtcgatttcaggaataacttcgatattgaatttagctgcatagctgactaattcatcaacttcttcctgagtccaaaatccacctttacggtcaacaaaatcagcagcaattttcgaatcataacgaataccctcgttgtctttaagtctcagctgtaagatattctgtttgtaatatgccatttgttcaatctgatcttttaaccattgaattgaatagtatcttcttccagagtcgacctgaagcccacgaacaacttgatcactgtaatcttgaacagaaccagcaggaaggctttttctttgagcgaaggcctgcaatatagtcattgcaccattttgaataccttgaatgtagtcagaatggatgacagttttgtcttgatcgatatcgatttgataggcatcgattttgcttgctgttacagctgcaggaagttcaaaagtgattggctgtttaactaaaacaataccttcaccttgtgaggcatcagtaacagttttgatcgtatagtctttgatcagcccttttttaaccatactgtcggctagatattgggtcttagctttactgaattcatcagttgaaaaaacttgcttagctgtatttaatttataaatttcatttccatttttttcaaaattctgaacagctgggacagtttctgggaattcagagaagtctgcatcatagttgatagaagctttctcttcaactgttttgttttctactttttcaattttgaaatcatcgatatagaaaactccagaacctaagtcattaccagtccattccatataggcaaaaccgtaaatttcattagttctaggaccagtagtgatagtatgttcattagtctgccactcagtgctgaccttttggttagtttggatattagaagcaagctgccaaggagacgtagtatgcttaccttcaatatcaagaactccggtagacatctttactccggattcattccagtaatgggtagtaatcttgtatgtagtgttaggctcaacgttatggaaaataacattaacactacctttaccataattataacgccagataggaacttcagaaggattttcaggtttaggattcccaactttgatagagtattttccgtcaaaagctttttcgtcagttctgacagctttgtagagttgaacttcatttttatcaatttcgtgttcaaaagacggattagtaattagtggagcatcggcagctttaagtggaccgacgttgatcgacatagccataagtgaggccatgacaatcggtaataatctctttttctttttcatatatctctttccctttcatgatatgataataaataaaatatagcagttatttgcgataacacctcctgattaatatgatgatttgtctatacatttctgtatctaactaaattgtaaagggcatgaggaaatgttacaatatagaaaattgcaaatgatttttaatttttgaatagattttcaaaaatagaatatcttttcacttcttgaaaagtagtgttataataatggcatgggttagtgctgttatagttttatgaataagaggggaacaataaaagccaaagaattttgaagtagtacgggaaaggaggatatcgaggagattcctcgataacagacaatggctggttttatttataaactgcaaaatattgtaaacacatcaccagatagcgatgatacaaatataaatatcgctagatgcattttaaaaaatattgataaaataaaaaaacggacttcattgcaagattttgctgatatttgttatacatcacaatcaagtattagtcgtttttcgcagtatttaggttatgcaaattttaatgattttaaagctgactgtattgggattcaagaagaaacagatgaaatgatcatagatactcgagcgactaaaaaaattaattgtgttgactatgcccaagcaatttctgaaagtttagtaagaatgcaagaaacatcaattgatcaagaaattgaacagttgtgtgagtatattcataatgctaaaagaatttttatttttgcaactcatattcctggcgatcttgcctgcattatgcaacgtgcaattttaacaacgggtaagtttattgaattttatcctcgtaaagagcatcaaatggaggttgctaagcaaatccgtcgagatgatctctgtatttttttatcattagaagggacattattaatggaaaaagcaatcactattccagcaattatttcattagctaaaaatgttctgataactcaaaatgttcatattaaattttcagaacaatttacacaagtaattggattaggtgggcatgatagtgaaagtattggaaaatataagttattgttctttattgattgtttgttaaatcgttattatcataagtacatagtaaataattaaagtagaagtacagttatttggacaaataactgtactttatttttaaaggatatttttaggtgttaaagaaaaaatatcttgagagaaataatattttatatatcttttatatttaatatcatatataatatatcggtggtggtgattagatggaattagatgaattattaaataaaaatcaaaaagaagcagcaacatatcttgatagtcatttgagaataattgctggagcaggatctggaaaaacacgggtggtaacgtatcgaattgcttatttgattgatgaaatcggtgttgacccgcgaaaaattctagctattacttttactaataaagcggcaaacgagatgaaagaacgaattacatcattattaggacctcatgcattaggttcgttagtttgcacaattcattcattatgtgtccgaatattaagacgacatattaatgtgattaattatccaagtaattttatgattatggatgaagaagatcaaaaagcattaattaaaaaaatttataataatttagatattgatgcaaaaacaatcagtattaaaagtatgattgcatccatttcaaattataaaatggctaatattgatcctgaacgagcaatggaattagcaggtcagtttcaaggtgaaataaagaaagctaaagtatataaagaatatcttgaatatcaagaaaatcattttatgcttgattttgatgatcttttattaaaagcagtatatatttttgaaaattatccagatgtattagaaaaatggcagcataaatttcaatacatccatgttgatgaatttcaagatgttggcaatattgaatatcgtttagttaaattgatgtcacaagatgcaattacttgtgttgtaggcgatcctgatcaaaccatctattcatttagaggggctaatgttaattatattcttgattttgataaagatttcaaaccttgtaaaacagtgattttagaccaaaattatcgctctacgggaaacattttaaatatttccaatagcttaattcgtaaaaatcgaaatcgattagaaaaagacctttatactgaggctactggtggtagtgaagttattcattatatgggaaagagtgaacaggaagaagcagattatatttgtagccagattgaaaaaataattagtgaagttgacggagtcaattatcgcgattttgcaattttatatcgtgctaattatttatctcgaacaattgaacaaagtatgattagtcatggaatagattaccggatttttggtggtttgaaattctttagtcgaaaagaggttaaagatgcattgagctatctgcagttagtatgtaatgatgaagatcttgcattcgaacgaattatcaatgttcctgctcggggaattggaaaaaaaacattagaaaatattcaattagtagctttgaataatcaggttagtttgtatgaggcgttgacactatttagtgatcaaattaagctgtcatcaaaagccaaaaaagaaataatcacattggttaaagctgttgaaacagcaaaacagtcaagtctgccgcttcatgaaatgtttgaaaatttgatgaacgatgttggatatattgatatgttgaaaaaggatttagaagataatcgaattgataatattcatgagttacaacggtcaatttatgaatttcaaaatcaaaatcctgatattgcaacaattgaaaattatttacaagaaatttcattatatacagataatgataatttggatgatggacaatatgtcagtctgatgtcaattcatatggctaaaggtctagagtttgattacgtttttgttttaggtttatcggaagggattttcccaagtttcagagcattaagcgaatcagatgaaggattagaggaagagcggcgtttggcttatgttgcttttactcgagcaagaaaacaattgtttttgacagatagtgaaggctttagttttgtaacagattctcctaaaatttcaagtcgctttattgatgaaatcgggagtgaggggattaagcatgtaggaacaaagccacgatttaaaacagcaaactttattaatacagctccaactaaagaagaattagtagggaataatgaagtgactgactggtcaaatggggactttgttttacatgatacttttggtaaaggtgttgttgttaaagtcaatggtaatactttagatatagcttttgaattgcctgctggtttaaagactttgatggcaaatcacaaagcattaaagaaactaacaaattaatgtgctaaacgcacattttttgttttatagttatacgtattttggtataatagttaagattaaattaggagtgagataatggatgatttaagtagatataaggaactaaaagcaacaattttatatcataatgatcgttattacaatcaagataatccagagattactgattatgaatacgatatgatgatgcaggaattaaaaggattagaacaaaaacaccctgaatatattactagtgattcaccgactcaaaaagtaggtggtagtgcaaagcgtgaagctggtgtactcgtacgtcataatgtgccgatgttatcattgcaggatgtattttctaaggaagatgtagatgcatttgttgcggatatgcaagaacaactggtagatccgacttttgtggttgaatacaagattgatgggttgtcaatggcattgcgctatgtcaatggtaagcttgatgttgctgttactcgtggtgatggtgtcttacaaggtgaagatgttactgttaatgctaaagtaatcaaggatgtaaaaaatactttaaaagaaccgattgaatatcttgaagtccgtggtgaagtctatatgaccaatgaagcatttgataaagttaatgaaattcaggaaattaaagggaagaaactttttgcgaatcctcgcaactgcgctgctggaacgttaagacagcttgatagttcaattactaaagagagaaatttatcaatgtttgtttttaatattcaagatgctaaaggcagagaatttataagccacagtgaaggatatgaatatttaaaacggcaaggaattaaaatcattgaagattataaaatttgtaaaacagctaaagaggtttgggaggcaattgaggcgattggtgaaaatcgtgataaacttggatatgatattgatggtgctgttgttaaaatcgatagttttgctgatcgacaaaaactcggagcaacagctaaagtacctcgttgggcagtagcttataaatatccgcctgaagaaaaagaaacaaaattattagcaatcgaattgtcagtaggtagaactggaagaataactccaacagccatttttgaaccaattcgtttatgtggaacgactgtatctcgagcaactttacataatcaggattttatcgatgatctagatgtgcggattggtgatacgatcgttgtttataaatctggtgagataattcccaaggttaaaggagtcgttaaagaaaaacgccccgctgatagtgctccatatgtaattggcaatacttgtccagtctgtggagctccagctgtacgtgaaggtgataatgcggatataaaatgcacgaatcatagctgtccaagtaagttagttagaaatattgttaactttgttggacgtgatgctatggatattaaaggttttggctttgcttatgtagaaacattagtggatcatggttatttaaaagatttaagtgatatttatggtttaattgataaacgtcaggaattacttgataaaaaaattattggtttagttaaaagtacagataatttattaaatgcaattgaaggtagtaaaaataatgatgcaattaaattgctaacgagtttggggattagtaatgtgggaaaatctgccgctaaaagtttaatgaaaaaatttaaaagtattgataatttgatgaaagctagttatgctcagttgattgaagtcaatgatattggtgatattagtgctatggcaattataaattactttaagaatcctgataatcaggcagttgttcaacgtttaaaagagtatggagttaatatgaatattatcgaagctcaagatggcgatgaacgttttgatggcaaaacatttgtcgtaacagggacattaccaactctttcaaggaaagccgcaagtgaattgattgagaagcatggcggtaaagtctcaggttcggtgtctaaaaaaacggattacttattagctggtgaaaatgcgggaagtaaacttaccaaggcccaaaatttgggaattaatgtaattagtgaagaaactttactagagatggtgaagtagctaaaatagtgttataatgcactgtataaaggaggaacactagaatgaaaaaaatagtggctttattagcgatagcattggtgctgagcggttgtagtgatgctaaagagaccgttgaaaatcaaacagcaaatgatgtatccactaccgatagtttagatgattcattttatcgagtagttaattttaatacgaatttaagtcgagaagattattatactgcttttggaaatactatggattttcaaacaattggacgagaattacagattttatctactgatcatttctcaactaatgattattatatgtctgaagggcaatatcttaaaacggatgatatgaatcaattattaaaacgctctgaggatactagtaaatatccttataccttacaagcacagcggggaactactattggcggagttgcaaatccaatcatggtaagtacagtgcatgaacaagattattatgaaaaaaacggatctgaatatgtcttaaagggtctatcattagcaatcgtactagatcctcgtgatgaaaaaaatgaacgtttagacacctcattagatgaatcgttagttgttgattttgggcgtgaagcaattagtaaattatacaaatatttacagagtaaaaaagacttaaaagatattcctgctaatatttgtgtttattatgcgactaatactaacgaaagtgatattaatggtcgttatattttaaaaagttattgtgatggcagtgtgggaaatattgaaacattagattacaaaaattatatgtttacaagtacagaagcaactgctgctgatgaagatacagcatcacaatttgaaatttttaaaagtaatatgaaaaaagctgcaactgaggcagttggtgtaattggctatggtcgttataaaaatggtcagattcagtcaatgaaaataaatttaaaagtaaatattaaaacatatactgaattgctttatttgatttctactgcagctgatgaattaaatactcaatttagtggttttgatattaaagtattagttagttcacaagatcaactagaggcattgattgttaaagataaaggtgaagatgcgaagagtatcttgttgtattaggaggtaatttatggaaaataaagaagaaatgttaaaaaagcttggattgaaaacaatgtttaatattactgatgcagaaatgccagagttagtagaagaatatgagatttttatgaatcacgttgccgtattagagaaaatagacactgatggtaaggcaccattagcatatccttatgaaattgagacatgctttttacgtgatgatgaaccgattgatgtaataagccgagaagatgttttaaaaaatgctaagagtgttcaagataatcaaattaaagtaccaaaggtggtgggataatgaaagtttattcaattgaagaattgcataatttaatcgttaatcaagaaatagatttaaatgaatattattatgatttatttaaagaagtggaatttcaacaaaatcgcttaaatgcatttgttacaatcactaaaactcaagcaatggataatattaaagaacttaaaatatctgatgaagaaatattgaaagggattcctggagtatttaaagataattacaatactaaaggaattaaaacgacagcttcaagtaaaatgctagaggattatgtaccagtttacgatgctgcggttgttgaaaaattatataatgaaggtgttagtttaattggtaaatcaagtatggatgagttagcaatgggtggtactaacaaatccgctctaactgggcctgtatataatccgtgggattcatcaaggatagcgggaggatcatcaggtggcagtgcagcacttgttggtagtggggttgttccatttgccttaggtagtgataccggagattcaattcgtaaaccggctggattctgtggtgtagttggtttcaagccaacttggggaagaatttcaagatttggtgttattccttatgcttcaagtttagatcacgtaggtgcttttactcgaaatgttcgtgatatggcaattgtaactgaagcattagctggtcgtgatgaaagagatatgacttcaagcacacggccagtaccacattatttaaaagaattgaatagtgatattaggaatatgaaaattgctgttttaaaaacagttagtaatgaaattagaaatgatgatattaaaaataatttcaaccatgtagttgcaaccttaaaacaattaggggcatgtgtcgaagaggtagaaattccagttcatctagctaaagcaattttaccaacttacacgattatcgctaatagtgaagcaacaagtaatcattcgtgcttagatggaattaagtatggtgatcggcaacctggttcatcaactgacgaagtaatgattaattctcgaactgatggatttggtgctcatattaaacgtcgttttattttaggaaatttagccttagctacagaaaatcaggaacggatgtttagaaaagctcaacgagtacgtcgtttgattgtagaagaattaaataaaatttatgataattatgatattattttgactcctaatggtggtagtgtagccccaaaacttgatgaagcaaatgatgatcgcctatcagatgaatacttgattttagaaaatcatttagctttaggaaattttgctgggacgccaagtatttcaattccgtctggttttagtgaaggaatgccgattgctataaatctgatgggacgtttatttgaagaacaaacagtattaaatgtcgcttatgctttagaacaagcattaggatttgaaaatcaatattcaagagaggggtagagagaatgaattttgaaactgttattggattagaagttcattgtgaacttaaaacaaaatcgaaaatgttttctggggccccagtaacatttggtgaggcaccaaatacaaatgccaatatcgtcgatatggggatgacaggggcaatgccggtactaaataaatctggtgttgaatttgcgatacgggtatgtaatgctttaaatatggaaatagatgaactggtacaatttgatcgtaaaaattattactattcagatttaccaaaaggattccaaattacgcaagatcgtttcccaattgggcgaaatggaacaatgaagattgaggtaaatggtcaaacacaagtaattgaaattgaaagattacatatggaagaagatactgcaaaacaattacactttgacgattattcattgattgattataaccgagctggtattccgttaattgaaattgttactaaaccgacgatccgcagtggtgcggcagcagctgcctatttagaaagattaagacaaattttcttatttacagaagttagtgatgctaaaatggaagaaggctcaatgagatgcgatgtcaatgtatcaattcgaccatatggtagtgaaaaatttggtacaagaacagaaattaaaaatttaaattcaatttcaaatgtacaaaaagcaattgaatttgaagttgctcgacaagagaaagtcttaattagtggtggtgaggtactccaagaaacacgccgttatgatgaagatagtaaagaaactgtagtaatgagagctaaaggtgatgcagtagattacaaatattacccagaaccaaatattttacctattcgattgaatcatcaatgggttgaaggaattattgaaagaattccagagatgccagaatcacgagtagctcgatacataaatgaatacaaaattcctaaaactgatgcattgatacttgttcaaactaaagaagtttcggatttctttgatgcgacagttgcttatactaagcattataaaattgcatctaactggttattaggcgaggtacaagcatatttaaataaaaataatttgattattacagatactaatataactcctgagtatttagcaaaaatgatcaattatattcaagatggaacaatctcaagtaaacaaggaaagaaagtgtttgaaatcttgatgaatgaaggtaaagatccagaaattattattgaagaaaataatatgaaacaaatttcttcaccggaagaattaactaaaattattaatgaagttcttgataataatcctcaatcaattgaagattatagcaatggtaaagatcgagctgtgggattcttagttggacaaattatgaaaaaaaccggtggtcaagctaatcctggtcttacaagtaaattactaattgaactattgaaacaaagaatttcataatgtacaaataattctatatttggtacaatggttgaaggaggatataaatatgtctcaaagaaaaagatttagttttgatgatgaagtagatgatacaattgatctatcaaaagatgatcttaaaaattcatcaataactaataatgataaaccttcaaacgacaatgtctttgctgatgaagatggtttagatgccaaagcttatcctactgataacgggggagataaatcaatgaaaaacaagaagaaacgcaagtttaaaattaagaaatggcaaattgcattaattgcttttctatcaataattattgtgttcgtcatctatgtatttgttgctggaggaaatgatggaccagtttatggtgatcgttgtgcttctttaattgcaattgacaaaagtaaatttacaggagttgaagatgcaatcaaagcagacccaagcgttaatagtatcaatattgaagtagattgtcgaattgttaaaattagtatgaattttgttgataatacttcttcagatactgctaaacaactggcaacaaacgccttacacacattagatgatactttaggtgaaaataaggaagaaggtagagcatatagtaatttatttactactgctaatggccgtggacaatacaacgtagagtttgttctaacgagcaatggtgatactaatttccctatatttggtactaaacatccaaatagtgatgatattacttttactggagctaatgtagttgatcaagctgcaactgatcgtgcggctaatacgaacgctaatcaatagacgagcatggctcgtctttatttatgaggaggactaaatgaaaaaaaatgattatttttatggtgaatgcacagatttaactcacgatggtcaaggagttgttaagattgataactttacatactttgtaaaaggtatgcttacgggtgaaagaggacggctaaaagtaataaaggtattaaagaattacggaattgcacgtttaattgaattagaagttacttcaaaatatcgtattgatcccaaatgctctgtctttagaccatgcggaggctgtcagttacaacatcttaatcctcaaggacagatgatttataaaacaaaacgggtcaaagattgtttagaaagaatcgggaattgtaaagtggcggtaaatgattgtattatgatggaaaaaccgtggcattatcgcaataaagttcaaatgccagttggagttaaaggaaatcatttagtaactggtttctataaacaaaagtctaatgaaatcatcccatgtgaaaactgttatattcaaaatgaattatcaaatcagataactaatcgagttaaagaattaatggaagagtttaaaatttacccatatgataagttagctcatcaaggtaatattaagcatattttgactaaacacggttatcatacagacgaagtaatgttagtactaattagttatcgtaataaaattaaagatatagataaattagtggaaataattacaaaagaatttccaatgattaaaacagttattcaaaatattaatcatcgcactgataatgtaattttaggtgaacaagaagtcattttgtttggtaatggatatatttatgatactttattaggtaataaatataaaatttctttaaaatctttttatcaagttaatccaatccaagtagagaaattgtattcaaaagcaattgaatttgctggtttatctaaagaagacatagttttagacgcatattgtggaattggaacaattacattatcagtagccaaatacgtaaaaaaagtgtatggtgttgaaatcgttgaaacggcaattgatgatgcaaaaaataatgcagttttaaataatattagtaatgctgaatttaaatgtagtgatgctggtaaatatatgctagaactagttaatcaagatcagcatttagatgttgtctttgttgatccaccacgtaaggggtgttcaacagaatttttggataatttgattcaagcagaacccaagaaaataatttatatttcttgtgatgtagctactcaagcacgtgatatcaagtatcttcaagaatttgggtatcatgctgatgtctgtcagcctgttgatatgtttcctcacacaacacatatagaaaatatagttcgtttgtcaaaatagccatgataaaaataattactaaacagatttcctaaaagaagtctgtttttttataatttatgacgagtaaattgatttcaattgttctaaatctataattatagtaaaattagataacctaataaaagcgggcgactgattgtgaaaaaatggtataatgaagaatatgaatttacaattgaagtaacagtttttacgtgggaataaagcagaacattattgctgtaatggtgaagaaattggtgataaatacacttgtacatatggttgctctaagaggtaatgatgatcatgtttccaattataggggtagttagattagaaataggggaaacaaaatgaatgcatttattttacttattccttttttattaatagcatttattaacgaaggtgcaatcaaacgggctggatattttgctccactgcaaggcaatgagaaaatagcttatgtaatttatcagatggccaatatcggaatctttatatattttttcttatcagtaataattgatttatcttggcagttttgtttaggtctactggtttatttgttaggattgggaatgtgcattgttttggttaaagattttttctccaagaaatgatggcttaaatactaacgagatttaccgtttctctcgaaatccaatgtatatgtcatattttattttctttttaagaaccgtattattaacacaatcaataatcttatttataattttattactatttcaaatctctatacattgggttattctttcagaggagcaatggtgtatcagcaagtttggaattgcttatgaacaatatatgaatcaagtaagaagatatatatagttaaataaagaattataaaaagaacaataataaatattagtagcatacttatgatgtcttattgttgttttgaagtaatattaatggtatactgagttccagtatagaggtgcgaaaatgaaaatagagtttaaaatgtcttataaattaggattattagaatttaaagttggcgatcaactagaaattagtaagaacactatatttgaaagtataaatgataagtattatatgttaattttaaaaggattgcgttatgatcttcttaaagaagatattaaaattattcaataaaatatttaatttggctatatcttagtgattagccattttttgttatggaaaataaacttaaaataattttattatctgtgctataataaatattactaataaacatttaatatttaacaattattatttataaggaggaaatatgcaatacatatctaaatatacttcaccgttaggagcaataacattagctagtaatggtgaagcattaacaggtctatggtttgatggtcaaaaatattttggcgctaatttatcaaaagaatataagaacgtagagttaccagtatttaaacaaacaaaggaatggcttaacttatattttaatggtcaaaagccagattttattcctcttttggctcttcaagcaagtgaatttcgtcttgctgtatggcaaatattgctagaaataccatatggacaaaccctcagctatggcgacatttcagccgttttagcaaagcaaaaaggtttaaaaacaatgtcagcacaggctgttggcggtgcagttggacacaatccgatctcaatcattattccttgtcatcgagtcgttggaagtaacggaaacttaactggttatgctggtggtcttgaaaaaaagattgcactgcttcaattagaaggagcggatatgggagcgctgtttactcctaaaaaagggacagcattataagttaattaaacttaaaaatggaggcatttattatgaatgattttgtgaatcttattaaagatgaagttataaaatctccattttattatagtcaagggtaccaatatagggattggagattactgttttattaattttgattgtattttttagatttgaatataataaccttgagttaccatgtaagaaatatataatttatgcaataaattgtaacaaataaatgaatatagtataatatatttaaatattataggaaagaaggaatgtagtttatgaacaaagaagtattaaattatattgctgaaaagacacgtgaattgattgttgctccaacttgcagtaatgaaacaaaggaagctgcccaagcatggttaaatgcgattggaacagaaagcgaaatggctgagactaagaaatatatcgctgaattagaagaagatattatgccaattgataatttaattaggtttgctggttctgacaatggtaaagcttattttggtgaagaaaatgctaaaaatattgaaagccatgctaaagaaattaaagctaacggggctaaatattgcgattgtccggcttgtttagttgttgctcaaattcttgaaaagaagtctgaattatttaatgaaaaataataggtttatgaaaatattgttcctttaggaacaatatttttatttaaaatgtaaatcctttttacaaaaatattcttttttaaggattgatttgtaaaacctcttctaaatagactttaatgtatttaagtaaataaaatatgatgttaaattaaatgcaagaaaatattagaggaggagtttaaatgagagcagtaacaacaatatttcctgttatatttatgattggaataggaactttttcaagaataagaggttttattacaccaagtcaaaaagatggagcaaataaaatagtatttaatattttatttccaataatgatttttaatatcctttttacttctaagctagagacttcagctatttttattgttttatatgtgtttattgcatattgtgttattttgtttattggaagatttataataaattttactggggaaaaatttgctcatatttcaccttacttgttaacgacatgtgaaggtggtaatgtagctttgcccttgtatctatcaattgtaggggcttcaagtaatactgtaatatttgatttagcaggtgtttttatggcttttgtaattattccaattatggttgcaagagcgggtgctggtgaaacaaggattagggaacttattaaaacaattctaactaattcatttgtaattgcagttattttggggttaggacttaatttattaggtacatataattttttatcaaacagttcatatttaggaatatacagtaatacaatcacccaagtaacagcaccgattgtaggcgtaattttatttatcattgggtatgatttgaatatcaatatggaaatattgggagcagtgttaaaattgttagttgctagaattattttttatattctagtgattattggtttctttatcttctttccagggcttatgattgataaggtttttatgattgcagttttgatttattttatgagtcctactggttttgctattccaatgcagatttcccctttatataaaagtaatgatgattgcggttttgcttcggcaatcatttctttgaatatgataatcactttagtagtttatgctttgatcgttgtgtttattgcttaatgttagtattgttaataaatttttgatatggcataatgaaaatatattattattggagatagtttatggttatttgattttaacatatttttagtagccgtaagagaagaaaatatgactaaagcgtctaaattatatattcaatttagctgatattgctatggtggttgatgcagttggaagaagaattaggtgtaaaactatttaagagcaacaatcacagcatttatttaacagatgaaagaaaattgtctagtaacgggctcaagaaattgttaatttaactaaaaaggtgcaagaagaacttattaaagatgacatggctttatctggtgttattacgagaggttgtggtggaatgcaaagtattgaagaagcaacaagattaataactgataaaaaagacttatcaacaaaggagtattaataatatggatagtacaataaaattcgatggcctagcaaatctttatgaggatggtagaccggagtacccgactatattaatagaaaagttatatactgactatggttttaaatcaacatccataatcgcagatataggtgctggaactggtaaattttcaaagctgttattaggacaaggtagtaaggttttttgtgtcgaacctaataaagatatgagaaatgaattagtcaataaattaaataaatataataaattgcatgctatcaatggaactgctggtaatactacgttagatactagttctgttgattttattacatctgctcaggcatttcattggttcaatgttcatgagtttaaaagagaatgtaagagaatcttaaaattagaagggcgggtagcattggtttggaatgtacgagaaatggagtcaccattgaatcaagagtgctttcaaatttataaacagtattgccaaaactttgttgggtttaatggtgggattaaacgcgatgatgaaagaataaaggaattttttgatatgcactataagcgtatggagtttccaaatcctttattttttgaccagaagggttttattaagcgctgtatctcaggttcatattctttaaaaaaaactgatcagaattattttgaatacattgctgccttagaaaatgtatttgataaatatagcaataacggacagttagtaatggagaataagacggttgtttatataggaagattaaaataaatgtagttcaatgtcaatgagaaatacttttatagctttaccattagttaaaggggcatatatgattatatagtcataaaagcgctttcttaatttaggcggtaataggaaggaagagatggccatgtaccatagattcccaactaaatatcttgaattagaattgactgaaacaatggtctttgcctaactagaagtttttagtaaaattattgagaaaattcattaggctggattcaactactctatggatgattttggaagtggctattcttttttaggaatataaaaagattcagatatcgttaagcttgatggtacattcttttcttctgaaacgatgaataaggggaaagaaaatattattgataagaaatagtgattaaatcactgaacaaattatttatagttaacattttgatagcattatcaaacattagatactattacattgattaaagctatattataatataattggatttaaaatttgagatataaatgtaagggagttaaaccatgggctttaatgatgaaagaaaacgaatgaatgagggtgaactttatcgttcaaatgatgcggaaattctaaaagaacaactacagtgtgtagaaaaattatatgattataatgtaacaaggccttcagaaaaacaaaaacgtaagggattgctaaaagaaatgtttgcagtgattggtgatggatgtcatattgaaccaccatttcatgctaattggggtgggaagtatgtacattttggtaaaggagtatatgccaatttcaatctaactttagtagatgatgttgagatttatgttggtgattatactatgatgggtccaaatgttacaattattactggaactcacccaattttaccggaattaagaaaagaagcatatcaattcaatcttccagtttatattggtgaaaatgtatggattggtgctggaacaattattttaccaggtattacaattggtgataatagtgttattggtgctggaagtattgtaacaaaagatattcctaaaaatgttgttgcttatgggcaaccatgcacaattaaacgggaaataaatgatcatgataaaatttattattataaggaaagaaaaatcaaaagtgtttaatatttttgatttttttatttatggattaaatacgtattactaataatattagtaatagctttaggtttaagctataatataaaagtataatgtaatattattgtgatccaatccaagaagatagtaagatgcttaaagaagcaaagaatgaggatttagaagcactaccagaactttatacacaatttgaaaacgtggttactgcttaagcattggaaagttagcccttgttcaatgactctaaatcaatatgcctaatcaaattaatattaatgatagaacaaaagaattcaaaataagaagatatttattttatttttattgcaatttttttattatcttatcattgttaaaggtgaaaatgcctagcactgagtctatctgtttataaaggtttatttaatagttgacagtaaaaaatagttagataataattagtaaattaaaattttgattgataagggggagtatggtgatggagaatatattagtaattggtaacggctttgatattgcacatggttttaatactcgttacgaagattttataaatttttgtaagactattgcaacggtttatcaaggatttaaggataatcaattcatatatcaaaatgaatataatgatatattaaaagaaaaattagataaggtttttaaagaaaagtcggtttctgccaaagcaataaaatatttttcaaacttaactccaacatctgaaacttctcaatttatcaaagcatgtaaagaaaattattggcttacatatgtcttaaaaaataaaagtatgattggggataagtggtcagatcttgaatatgtcattgctaaacaaatagagatattatcatatatttcaaataatcttaactggcatactcgagaagaaactatgctcgcttcacgatattctagtaatttaattgaattatttaagattgtaacagaagaacgtggaaataataccgattttcagcatcagatagaactcacaaagaaacatttatatcgagaattggaagaattaacatggttattagaaatatatttaacacgatttttaaatactaaaaccaagaaaattgaattatttaaatatttaccagtaactaaactcatttcttttaattatactgatacgtacacaagaatgtataaaaaagaaacaaatacagttcattatattcatggatttgctgctaaagataggataaaagaagaaaataatatggtttttggaattggctcagaaattaaaaatgtcaccgataatgataagtatgattatcttgaatttcaaaagtattatcaaaggattgttaaaaaaacaggtaataactacactaaatggttaaatgacaatgaacaattttatatctatttttttggtcattccttagatattgtagatggagatgtaattagaaaactgattcattgtaaaaaagcaaaagtaattatcttttattataatcaaaaagccttgaatgcattagttgttaatttagcaaagattttaggaaaagatgaacttattcaattcactaatgaagaaaaaatcactttttataaatctgatgattttgaaataattaaaaaacttaaaaatacaatgtatcaaactcgtcatgagaagcttaagagtacagttagataaatccaattagaaatgaggaaataatatggagaaaatcattaaagtgggaataggtgttttgttaatcaagaataatcagattcttttaggacatcggataaaagatggggttgatactggtggcatctatgaaccggacacatggtgtctaccaggtggaaaacaagagtatcatgaaactatttttgaaggagcaattagagaagttaaagaagaaactaatttaaatatctcacagatagaagtttttaatgtagtcgatgatattcaattaaataagcactatgtaacgatacatattattgctaaaaattacgatggagatttaaaagctatggaaccagataaacaagatgagtggtgctggtttgaaatagaaaagctgcctaataatatttattccccttcaaaaaaatttattgaagcatatttagatagaagtatcacctagataaatcttattataagaacgatatttttgaaatcattggcgttgaagaatagactaaatacattattaacaatgtggttaacacgtgtttatactattaaaggaaatattatgaataaatatacaatgataaaagaagttatttgaaaaacaacaagatattaaaaaagcagataaaacgtcaaaatatatgagagatttatttacattttatggaattccctcaccctagcgcaaagataagacaaatacaaacttgctggagcaaaaaattgttaatagttttggaagtgatgagttttttattaataaagcaattggctggagtttaagaaattattctagaactaatttggtatgggtaataaactttattattaaatatcgtactctaatgaataagctaagtattaaagaagctagtaaatatttataatttatagtgttgcatgtatttttttgatatttaagatggatataattgataatatacaaagttattataagaatatattttatgaaagagtatttcgcctgtaggtatgatttgttaatagactgtttattctgagagtctgacaaatcttaaagattgagacgcatatgagtctgttattttatatagaaaattttgtagttgtaggaaggacatatcctttaatatataccgaggaaaaggaaaaaggcaagacattatttattgaaatactattaattggagttggactcgcaatggctacattgttgtatcaatttataaagcttaaggaataaaaaatagctaattatgctattggaagaattgatattagaaatacagttttaaaagaatattacctccattgattattgggtagtgttacttttttaactattattgatggaaaatgatttttgaatatttaggaatgcttgtatttttatatataagttaaaagaggggaaacatgacagtctctcttcttttaacccttcattccaatataaataccaattatataaggaatcaaccatattgaccaaacgataatactaaatttatgaaaagtttttttagcacgatcattttttttaattagtattactgttgcccaaactgcatgaaaagccattaaaagtaaagcaattgatccagtaatgacgtggagattaaaattaaaattgtgccctgatatttgtcccataatattcgttcctgatgtatcacaaataaagccaagccaaaatatcaaagcatgccattttagtaaactgccactcttttttcagcaaaaacaccgattgtataaaaaaccagtgctagcgtcatgaaaataattgccataataagtaatattgacatataaatgtatttctccttaatctgtaaattctttttttaaagaaattaataatattagtaatgcaatcatcatagtaatatgtgaaagtcctgcaaaaccagaaagcatcttatctatcaaactatttatagccgtattagttatttgtagaatcccacgaattagcatagtgaggatcataaaaggtaaagaaaaattataaatgattacaaattttttaaatagtcgattattttgtatatttgtcacttttgcaattacagctaggatgataaacagtaatgttcctaaaattaataaatgaggatgaattacacttaatacggtaggcattgaataagcataaaattttgtaaattcacgataaaaaacacccccagccattgctaaaataaaatatataatagcaatatttattaaagatttaggagaataatctaaagtcttatttaatgatttatagtaatttaaaccaaagatgataccggccaaaaatagcgcagctcctaaaccagtatagaaaatagcgataaatctatccggtaataaattaaatgttcgaattgttataccaaaaattatcataaatgccataataataaatgatttaagatcaaagaaatttaaaaagaattgtttttctatttcatagctatgaattctatgggtatgttttttagttaatttgtaaaatatagcaaaccaaaaaataataaaaacaatgattgagagaaagaaatttaataactttgtatatccaacatatgtttcaattccaatttttaaaatattgaaaccagcaataagccacacgattgaagctattaataataaattatacttttttactttcataataaacctccataattaatctgaacactgttcactttgaattataagtattcccacttcgtaataagtgggctagtataaatatcgttcaactaactcaataataccttggtagttttgttgtggattaacgattgaaaaaatgaaaagttcaaaaatatactcaatgaataaagtttgatctaatttttgattaaaagcatcttttcttattttttgatctttttttaatacaattaataaattttgttttaaatggaaaaaatattttttcatcattttttgtccaacgactttatcttcagcagctaaagacattgcatgttttgaaagaaattcaggatattcttggctgccttcttgaatactttcaaataaccaagtcaaacattcaatgaaattcgtaaaactaaattgttcactagacatgtgaaaaatatctttccaaatactttcgatagtcgaacataagagttctgattttgatggaaaatagttatatattgcgcctactgaaacactacattcaattgcaacagaacgcatattaattgaagatagacctttttctttagctaaacgttgacagatagaaattatttcttcttttgatgttgatggtaaattcaaaatatttcctccttataattttatatgaaccatgttcatgttgaataatacgccttatttttataatagtcaaacataatgactttgcttttttatcaattattttaaatgaatctagagtttggctgattactattttatgttagaatgatagtatcaaaataaattatatttgaggtgaaaaataatgttgattgttgatggagaaaaatatcttgcggaaataaaagaattgatcattgagtatacaaattcattgaatcgagatttctcttttcaaaacatagatgctgaattagaagatttaaaaagaagatatctatagtctcatgggcgtattttagcggttgtcgactgatggtaaagctgttggctgtattgcttattgtcaccatcgtaatcaatgctgtgaaatgaaacgtctatatgtaaaaccagattttcgtaatcagtgacaaggtcaaaaattaattgaagcaattattgaaactgctcaaggagatggttttggatacaatcaaaccgttaaaaagggcgatttcgttatataaaaaatatgtttttaaaaaaattgaaccacattatgataatccaacggatgacgtaatttatatgaaattagtattctaataagcaaagaaagtgagataggttaatgggaatattattggttaggcttattgatgtaataaatgaatatagtgaagatagtactttttatagtattgcttatacaatgcttttgaattttgataatttgcaaaatcttagtattaatgatgttgcaaatttatgtcatgtatcaaaatcaactattagtaagtttgtacgatcattaaattttgaagattattccgattttaaggcagaagcatattttaaggaaaatcgttttaacagtgattataattatgttgccaatatccaacaatatattgctaatcaagacgcaaatacctatattgacaaagttattcaggatattgaaataatcaaaaatattgatatgacagtgattagaaaaattgctcaaataatttatcaatatccaaaagtcacggcatttggaacacttttttcacaattgggagcgttagatttgcagtataaactggcctataatcataaatttattatgagttatgtaaatgatgttaaacaagacgaatacttaaaaaataatagtgaacaaggtgttgtgatcatttattctaattctggtaactatttaaataagtatcagttatcatcatttgatgaaaagaaaaaatacgactataaaaataaaaaggttattttaattactgcaaacgaaatgatggtaaatcatcccgatgttgatatttgtcttgtctatcagcatttatctaaattacaaacacatagttatatctatcctttgattaatgacttgattgttgctgaatatagaagtttccaaaatgcgaacttttaagtttatataaaaaactccgttataatagtagtatcaaaggaggaacaaagtatgagtagatttccagataattttttatggggtggagctagtgctgattttcaatatgagggtggatttggtgaaggtaatcgcggcttgattacagcagattttgtaacagatggtaatgttgatacgttacgtcaggtaacttataagtgtaaagatggaacgcttggttcgtcaccattaaaggctgaaattcctgaaggagcaactggatatattgatcctgagcgttattatccaagtcatgatggagttgatttttatcatcgttataaagaagatatcgctttaatggcagaaatgggatttaatgtttatcgttttagtatttgctggacaagaatttttccgacaggcgaagaggctgaaggaaatgagttaggtttgaagttttatgagaatgttattgatgaattattaaagtatcacatagagcctttaattacaatttgtcatgatgaaattcctgcatatttagctgatcattatgatggatggtcatcacgccatacaattaattgctacttaaaattatgtaaaacattatttgaacgttttaaagggaaagtaaaatattggttgacatttaatgagcttaatgttgtaaagggttatgctcaaatgggaactcataaaattgatagtcaaacgcattatcaagcgatgcatcatgtttttgttgctagttcattggcaacaaaaatggctcatgaaatgatgccagggtgcatggtaggaacaatgtatgcaatgagtggtttatatccattaacttgcaagcctgaggacatgatggcacatatgaatactagaagattatcatatttttatgcagacactatggtaactggcggatatccatattatgcacaagcattatttgaaaaagaaggggtcgtactggttaaggagccaggtgatgatgatttactaaaagaatatccactagattttattacttttagctactatagaacaacaaccgttaatgctaacactaaattaaatattatcggattagcaatggatctaaatccctatttagaagcaaccccttggggttggccaattgatcctgttggattgcgctatgttatgaatgaactttatgatcgttataaaaaaccaattatgattgttgaaaacggaatgggtgaaatcgatcattttgaaaatgatacagttatagatgattatcggatccgatatttaaaagatcattttaaaaacatgaaagatgccattaatattgatcatgtagattgtattggttatacgatgtggggggctattgatcttgtttcacttagtaccggggaaatgaaaaaacgttatggttttgtttatgtagataaaaatgatgatggtagcggaacatataatcgatataaaaagaaaagttttgattggatgaaagaagttattgcaacaaatggagaaaagatataaggagggaaataaaattccctttttttaaattttaatcgggtctatttataatttaggttaatatatttaaaggaggaatgattaggaggaatcatagatgtgtacagcaataaagatatattcagataatggagatatttattttggtcgaacaatggatttttcatttgaattaaatcctgaactttattatattcctgcaaaataccagtggcgcaatgttctaaatactcatgatattgaaaataagtacaatattcttggtatcgggcaagatgtctctcctgttgctttaagtgatggtgttaatgaccatggatttgcagttgcggcattatatttttctgggtttgctcaatatgatgggctaaaaaaagataatacatcaattatcccgatcgctgcttttgaactagtttattttttattaagtcaatgtgcttcagtaaaagaagctcaagaattaataaaagtcatcaaaattattggtgtagaagatagtattacacatatagcagctcctcttcattggataataagcggtgcaaataacaattgtatggtgattgaaaaaacaatagatggtctacatgcgattaataatcctattggtgttcttgcaaatagtccagatttttcttggcatatgactaatttatgaaattattacaatttatcgccatatcaatttcaagaagcaatatggaacaatataaaacttactccatttggacaaggtgcaggaacattaggcttaccaggggattatacaccaccatcacgttttattagagcagcatttcaaaaaacatatacagatattccaattgatcgtcatcaagctgtgataacttgttttcggatcatggaaacggtcagtattcctaaaggggtcgtcattacagcaaatcaaacttctgattatactcaatatacgatgtttattaacttagcaactcgagaatattattttaaaacatattggaataatcagataacaagagttgaatttcctcaatatgatgaaaaagatatgaaaatgctttcattaggaccgttaaatcaaacgattgaatttaaaactagaagtatttttttataaaaggatgtgttgttagatacatctttttttgtttatatttatgattattgtgaaagaataaaatatgcttaagcatattcgttgaagataatcgaatgactatgctagaatggcattctaaggatgtgaaaaaaatgttgatacaaaaaagaaatggtctttttcaagactatgataacaacaaaatagaaacagcaataaaaaaagctttttgcagtttatctgaaacaataaaagatgatgaattaaaaaagatgattgcagatattgaaaaacatattatagctgatatgtctgttgaagcaattcaagatttggttgaagaaacattgatgaaacatggatatcttcaagtagcaaaagcttatattttatatcgtcaaaagcatacggagcagcgattgataattgatgaactgcttgccttattgggagatcaaaatctaaaaaaggttctattgaagattcacaaagactatcctcaagaagaatattcattgcaattattattagtgaaatttaaaacattttataaagagggtatgagtcattttgaagcgttgaaaatgttgatgaaagcgagtgtggaattaattagtaaagaagcacctaaatgggagatgatttcagctcgatttttaacttatgatgtaaatcaacaggttgaccaaaaaatgaataccgctggtagatatactttttatgagcggattaactatttagcacaacaaggttattatggacaatatattcttgaaagctattcaaaagatgaaatagacatgttaggacagtatattagcgaatcgcgaaatgaattatttacatatagtggtcttgaattgattgttaaaagatacttgattcaaaatcatgaccgcgaaattattgaaaaaccacaggaaatgtttatgtcaattgctatgcatttggccatgaatgaatcaaatagagttaagtgggcaaaagagatttatgatattttaagtactttaaaagtgacgatggcaacaccaactatgtctaatgcgagaaagccatttcatcaaatgagttcatgttttattgatactgtcgatgattcattagcaggaatatataaaagtatagataattttgctaaagtttcaaaaaacggtggtggaatgggactgtattttggaaaagtacgtgctaatggaagtagtatcagaggtttcaaaggagcagcaggaggtgtgattcgatggcttaaacttgtaaatgatactgcaacagcagtagatcaattaggagttcggcagggagcagcagcagtatatttggatgcatggcataaagatctacccgaatttttacaaattagaacaaataatggcgatgatcgaatgaaagcacatgatatttttcctgcggtttgttatccagatttattttggaaattagctaaaaatgatttggaagcttcatggtacatgatgtgtccacacgagatacatgaagttaaaggttattatttagaggattgttatggtgaagagtgggaaaggaaatattatgagtgcgttgaagatgaccgaattcctaaacgcgttatgacagttaaagaaattgttcgtttaattattaaatcactagttgaaacaggaactcctttcacatttaatcgcgatcatgttaataattttaatcctaatcctcatcagggaatgatatattgcagtaatctttgcacagaaattgctcaaaatatgcaagcgatggagatcttaccgtctgaggaaattgaggttaatggtgaaactattattgttgaaaaaacaaaaccaggtgattttgtagtttgtaatttagcttcattaacattaggtcatcttgatgtcttaaatgatgatgaattgagacacgttatcagtgttgtaattagggctttggacaatgtaattgatttaaattattatccaattccttttgccaaaataactaatcaaaaatatcgtgcgattggattaggaacaagtggttatcatcatatgctggtaaaattgaaaatgtcatttgaaagtgatgagcatttacagtttattgagcagctttatgaaaagattaattactttgcgttggaagcttcatgtgatttagctaaagaaaaaggaagttactcattgtttaatggtagtgattttgaaacaggtgcatactttataaaacgtcgctatcaaagtaaagcatggcaaaatcttcaagctaaaatcaaagaaaatggtttaagaaatggatatcttttagcgattgccccaaccagttcaacttcaattattgctggaacaacagcagcggttgatcctatcatgaaaaagtattttatggaagagaaaaagggaagtatgattactagagttgctcccgacttagattctgaaactttttggttatataaaaatgcgcattatattgatcaagagtggattgttaaagcagcgggaattaggcagcgtcatctcgaccagtcacaatcagttaatttatatatgacaaatgagtttacttttagaaagttgcttaatttgtatattaaagcttgggagtatggtgttaaaacattatattatgttagaagccagtctttagaagttgaagaatgtgaatcatgcagttcataggaggtaataatggaacttaaacaaaaagcattatttaatgctaaaggtgatattgatgtaagaaaacgtcgaatgataaatggaaatacaacaaatcttaatgattttaataatatgaaatatcagtgggtcagtgattggtaccgtcaggcgatgaataatttttggattccagaagaaataaatttgactcaagatattagagattatcgtttgttaagtgaggcagaacgaaccgcatatgataagattctttcatttttagttttcttagattctttacagacagccaatcttcctaatattggtgagtatattacagcaaatgaaattaatctttgtttaaccattcaagcatttcaagaagcggtccattcacaaagttatagctatatgcttgattcaatttgttcaccaactaaacgagatgaaattttatatcaatggaaatttgatgaacatttgttgaagcgaaatgaatttattggtgaacagtataatgcatttcttgaacataaagatagttttcatttaatgaaaacgattatggctaattatattttggaaggaatttatttttattcaggatttatgttcttttataatttagggcgaatgggtaagatgtcgggatcagctcaagagattcgttatattaatcgtgatgaaaatacacatttatggttatttagaaatatgattattgagctgcaaaaggaagaaccgacattatttacccctgaaaagattgaggtttatcgtaatatgctaaaacgtggagttgaagaggaaattgcttgggggcaatatgtcttgggaaatcgaattgagggtctaacgatggatatggtcagtgattatattcattatctcggtaatttaagagcattttcattgaattttgaaccattatatgaaggatttgagacagaacctgaagcaatgaaatgggtaagtatttatagtaatgcaaataacattaagaccgatttttttgaagcaaaatctactgcttatgcaaagtctagtgctattgaagatgatttatagaatatttagaaaagcaagatagaaaactaccttgcttttttgattgatctattgttcagctatttgatgcataaacgtttattagaggaggatatattgatgtatagaataaaaaaatccgttattattttcttcgcttatcgcatttattgttagcctgatctatttattaatatctatagtaatagcagtatattataatctatggaatggtctattccttcattcttattgtaattcagtcgtttttgtgttttgtttcctgtgataatgatgagaaattttttatacaccgctatatattttattttcaaatattaatgtggatgtatcattggataatttagctttgtcttcaccagttgtctcgagcatgtacttaaatatcattatgatagcatcagtaggaatcatcggttatataattttacagtctattcaccttaataaacagccacctttaattactgtctttagtatttcagcgatgcataggtgctattttaatgattttaattttattttgtcaaagctccgatgctattattaaggcgtgaacatgaagctattgttaatcatcaattatgtatcactaatacttttgaacaggtttttaaagaaaaaatgctaaaactttataaaaaagttcggtatctttgtaatactcatggatatccttttactaaaaatattcattcaaaatatcttgctgatttaatttatctaaaaatgaagcttctatgatactttttactgattatctatctggtagacagtaagcttaaaaactgtattgcaatgtgatatattaaactttgcctaaaaataataactatgctagtaatagtttatttttttattatatatttgtttgacaagtctaacaccaggagataagatataattgttggttagattaggctaactattataattgttttaattgaaatatttagcattaaatcctattttaaaaagattatagagggtgttgtgtggtgaatcggatgattctattcgaaaaatcaatttgtaagattgaaaaatgagaattatccatattgtgtgatgatggaaattaatgggatgagttgtaccgattgtcagcaacaaattgaaaatgagtttaatcagaagaaaatttatttagaacagcatttggctgtacttctaccaaaacaagatgcaagtgtggaatcagtctaggttttaatagagatagttggctatcgtgttattaaattaaaaaaatctgaattaaaagatagggggatttatatgtatttgcaattagaaaatgtagaaaaatattatggtgaaaatgaaaatcgggttcaagttttaaaaggggtcaatggttcaatagaacgcggtgaaatctgtgttatgctaggaccttcaggctctggtaaatcaacattattaaatttaattggaggtatcgaaataattgattatggtaatgtgatagttggtggaattgatttagcatctttatcaaaaacaaaattagggttataccggcgggatactttgggctttgttttccaattttatcatctagtcccaaatttaacagtaaaagaaaatattgaaacaggtgcatatttgagtaagacaccactagctgttgaaacactattagataaattaggattaaaagaacattgcaataggtatcctaatcaattatcaggaggacagcagcaacgaactgcaattggtcgtgctctagcaaaaaatcctaaattattattatgtgatgaaccgacaggagctttagattatcatacatctaaagatattttagaattattagaacagattaatcaggattatggaacaactattttaattgttactcataatgatgcaattgctaaaatggcacatcgcgtgctgcgtttgcgagatggacaaattgtttcaaactatttaaatacatcacgaatcaatgctaaagagttagaatggtagtagggtgttagcatgaaaaatccattaaataagagtttaaaaaaagaattcactgataacttagctcgttatctagcacttgctttggtcatgatagttatgattgcaactgtttcaggtttttttagtgtagcttatagtgttaataatctattaaaacaaaatcaagatgaatgtttagtcgaggatggacagtttactgttttaaaaccattgactaaagaagtaattaaagaaattgaaaaagagcctgtaaaactttatgaaaatttctatagcgagcaaaagatcaaaaatagtgctacattaaggatatatcaagatcgtgaaaatattaatttggttacagtttaccaagggaaactcccaaaaaagcatcaagaaatagcattagatcggctttttgcaataaaaaatggttataaaataaatgatcaaattaaggtcaatggtataaagttaactatcgttggatatttaagcctacctgactatagttcgttgattaaggataatagtgatttaatgatggatcctatccattttggagttgctattgtagatgagtcagattttgctttattaaaagagaataatattaattatacttatagttataaatcaaatgatgatttaagtagtaaagaaaattacgatcaattaaatcaaattagagatatcgtagttgatagtggatgtagcttaacaggaatgatgacccaagagatgaaccaggcaatatcatttttacctaatgatatgggtggtgatatcccaatgatgaatatgttgttttatatcattttggttattttagcctttatttttgttgtaatttcacaggcgataattgaagaccaagcaactgcaattggcacattactagctaatggttatacaaaacaagagttgattcaccattatcttactttagtaatgatcattgtttttgtaagtggactagtgggaaatgttattggatatacaataatgccttcatttttttctaatatgtactataacagttattgcttgccaccattacagttaaaatttattcctagtgtatttgttaatactactgtgattccttttttggttattttgatagtcaattatttaatgttatggcataaattaaatatttcgccattaaaatttttaagacaagatctacatgaaaataagaaaagtcattatattcatttaaagcaaacgtcgtttattaagcgctatcgtcaaagagtgattcttcaaaataagggaagttatttggttttaatgattggaattatttttgctagttttcttttaacttttggtttttgtattaccccgtcgattgaacgttatttagaaaatatggaaaatagtattaaaacaaactaccaatatcttttaaaggtaccagttgaagctgctggagaaaaaataacatatacattattacaaacctattttgctgctggggaaattgacttagatgtttcattctatggattagatgataattctatatattatgcggatattgatttgccaaaggaaaaagatcaaattattatttcctacgattttgctaaaaaagttggcttagaaaaaggagataaagtaacgtttacaaaccaatatactgaacaagaatatcagttaaaggtttttgatatttataatagccgaactaatataagtgtttatatgtcacgtgaatcattaaataatttactcgaagaagatctgaattattataatagttatttatcagatcagaagttaaatattgataaaaaatatcttagtacgatgattactaggacagatatgctgaaaattggcgatcaaatgacggaaaccttttcacagatgattccgattatgagtgggatagcgatagttatttatttagttgtaatgtatattctaacaaaactagtattagatcgaaatactaattatatgtcgtttttaaaagtgataggctataacagccaagaaattgctaagatatatcttaaagctacagctttggtagtagtattttcattattgattagtttaccaatttgtaaatatggtttagaaatattgtttattcaagcaatgatgagatttgcaggatatatagaaatctatattccaacctacctctatgtaatgatttttactgttggcttaattacttattttgttgttaattggctattgaataaacaaattcaaagaattgatttagggaaatctttaaaagaaacagaataactataggttattctgttttcacctaaaaggaggagattttaatgcttgaagatattaagctgccgtttatagataaaaaggttattaataagcatgaaagagagtatcaaataggtttaatcgatggacagggagtaatgacgagcatagatatttatccagggatacaagttatatataataattttcattgttttactgctccgactgatcaatctctcaatcggcatcgttatattgaaattaatcattgtctaaaaggtaaatttgaatgtcagtataataaaaattattatgcatatttatgtcaaggagatttagcaattagtggtggaacattaaataaattaactcactcatttccattgggttattataatggtgtagaaattttgattgaagtagaaaaagctaaagagaataaattattagatgaattcaatattgatattgatttaatcagtaaacgtttaaaagaaagccataatgtatatatttttcgtgctactgctcaaattgaacatatttgtttagaaatgtatgagatagaagaggaattaaagaggaattacctaaaaataaaagtgttagaactgttattatttttatcacatcatgactttggaattttagaaaatgaaaagcattattatccaaaaaaacaaattgagattatcaaggcaataaaaacagagcttagtaacaatatttcagctaaatatgatcttgaaaaactagtaaaacaatacaatattaatattcatacatttcgtaaagcatttaaagagattcacggtaaaccaatctatcagtggtataaagaatatcgtttagagtatagtttaggtctactgattaataccgatattccaattatcgaaatagctaatgagattggttattctaatccaagtaaatattcagctgcattttatcaatatacttctatgacaccccagcaatatcgtaaatcacatcttaaaatggagcaataataacaaaatggagtagcagtaataatatttaggagttatactctcttataaagttagtctattctaactaaaggagggttaatatgacagtattaaaatctttatttgcttatgctggcaaatataaatatttaacaatactttctttagtattttcaatgataagtgctattttattattaatgccatttattatgatttggaaagttattgaggttattttggcagagtatccaaactttgcccaaggaagtattgcgatacaatacggctggtacgcgttaatttttgctgcagttggaattttattgtatgtttcgggcttactttgctcacatttagctgcatttagaattgcttcaaatatgcgtaaaaaagctttacatcatgctgttcaattaccacttggatattttgctaaagaaggaagtggtaaattaagaaaaattattgatgaagctgcagcttcaacagaaacttatttagcacatcaattaccggatatggcacaattgattactactgtttgtgcggtaatagtctgtttatttatttttgattggaagtttgggatagctgcactaattccaacgattttagcactatcaaatatgtttaaaatgattggtcctggcttacaggaatcaatgaaagcatatatggatgcacttgaaggaatgagtaatgaagcagttgaatacattcgtgggatacctgttgttaaaacatttcaacagacagttttttcttttgatcgttttcatcaatcaattaataattatgaaaaatttgcaattggttatacaaataagatgcgtttcccaatgactttgtttacgaccttcatcaatagtattttcattttcattattggcacaatgatgttattgatcttaaacggttttgatttaaattctttaatgccagatttcttattttatgttatttttacaccaattattgcagtaacaactaataaaattatgtttgcaagtgaaaatacaatgatggctgcagatgctttaaaccgaatcgaaggaattattaatcaaaagccgtttacgtataagcatagtctgcaagaaatcaccaatagtgatatcgaatttgagcatgtctcttttacttatccagaaagtgaaaatgaagtcattcatgatgttaatttgaaaataaaaagtggttctattgttgcttttgttggtaaaagtggaggtggtaaatcaacgctagtatccctaataccgagattttatgatgtgactaaagggactattaaaattggtggtgtcgatgttaaagaaattagtgaaaaagaattaatgagtaagatttcattcgtatttcaagacagtcgtcttttaaagaaaagttttaaagaaaatattaagatgggatcaaatgcaagtgttgaagatattcagacggcagttcataaagctcaatgtgatgatattatagagaaatttgatcaaggattagaaactaagattggtagtaaaggggtttatttatcaggtggggaaacccaaagactgacattagcacgagccattgttaaagatgctccaattttgttattagatgaggctactgcttacgctgatagtgataatgaagtcttaatgcaaaaagcaattatggaattagcaaaagacaagactacgattatgattgctcatcgactttcaacaattgtaaatgttgactgtatctatgttgttgataatggtgaaattattgagagcggaacgcatcaagaattattaattaaaaacggattatatgctcaaatgtggcatcaatattgtcagtcagtagaatggaaagtaggtgaacaagaatgataaaaaaggttcaagagcgttttgctttaacccatttgggagcagttaatttaattaaggcttgtgtttcatgtacgatatcatatttagcaatcgcaatgtcaattggagtgttatattattttacttgtgatgttttagaaatgctatatggcagttcaaatacaatcttatattcaatgtatctgattgaatttgtaatagttgttatcttaatttttatcgctcactatattcaatataatatgactttttataatacttataaagaaagtgcaagattaaggattcgtgttgctgaaaaacttcgaaaattcccgttaatgtttttttcaaaacgtgatttatcagatttaacaacaacaattttgtctgatgttacgggaatggaacaggctctatcacattttattcctgaattctttgggtcaatagcttccacacttttactatctatatcgatgttctttttcgactttaggatggctttagcagctgtttggtgtgttcctgtatcatttttattagtagttctggctaaacgaaaattaagtaatgctggatttaaagatcgtcaaaaacaattagttcgaactgaaaagattcaagagacgctggagacaattagggatttaaaagctaatcactatactcagcagtatcttaatgaggtagatcaagttattgatgattgtgaaaagagtcaaattaaaacagaacttacaaatgctttatttgtagttagttcacaattgattttaaaattaggaattgcaacagtagtcatttatggagtaacatcactaatcaatcaaatgattgatctgaaagtctttatgttatttttaattgttgcttctcgtctttatgatcctcttagtgggacattacaaaacttagcagcgattatcagttgcgatcctaaaattgctcgtctaaatgaaatagaaaattatccccttcaaactggtgaagaaaaatttgaaccaagtaactatgatattgaatttaaaaatgtaagttttgagtaccaatctgaaaaaaaggtacttgaagatgtaagttttgttgctaaacaaaatgaaattacggctttaattggaaatagtggtggcggtaaaacaacctgtgcttcattagctgctcgtttttatgaattaaacgaaggggttattaaaataggtggaattgatatttctacagttgatcccgaaatactattatcaaaattttctattgtttttcaagaggttgttttatttaataatactattttagaaaatattcgcattggtaaaaaagatgcaactgacgaagaagtcatggaagcagctcaaaaagctttttgtgatgagtttgttgaaaaactgccagatggatataatacggttattggtgaaaatggttcaaaattatcaggtgggcaacggcagcgaatttcaatagctcgagcaattcttaaagatgcacctattattttattagatgaagcaagtgcttcattggatgttgaaagtgagacctttgtacaaaaagcgttatcacgtttgattgctaatcgaaccgtcattatgattgctcaccggatgaggacgattgctaatgcctctaagttgattattttagaagatggacatgtagttgagcaaggaactccagaacaattattacgtaaagaaggggtttatcaaagaatggttgacctgcaaaaaatgagtaacgagtggaaattataaaaactagcaagatattgctggtttttttgttagatttatataactttagattgactatgacgaaaaaaagagtattctaatagtatagggtgttagttttgactaacatctttataataagttaggaggaacattaatgaaagatttattaaaaaacaaaactgtattatcctttgtaggaggaattgcagcaacgattgctggtgcaaagtttttaaaaagcgataaagctagaacaatggcggttaattctttagcttcgggaatgaagctaaaagacgatgcgatggctacttatgaaacgatcaaggaagatgcaaaagatatttgttacgaagcaaaagctaaaaatgagggagaatagataggttatgaaagcttatcaaattgttcatgatatgcctggacgaatgcgaattcgttatggtaaatatactttttcaaaaactgcagcaattggattaagctatgaattagaacgttggaaaatggttaataaggtcgaagctaatgatataacaggaagtattttatttatttatgataaaaatagaagaagagaattattagctttaatacgacaatttgaaatagaaaaatttgatgtaacaccatatctagcgacaatcaaggagtataattcttatgaaataacacaaaaagaagttagccaaaattatacttctaaatttataaagttattgcttcgccgttattcaattcggtggtttttaccaactccgatacaatatttaagcagtatcgttttagcggttaaatatttcaaaaaggggctagcttcattaggtaaaggacatattgatgtgccagttcttgatgcgacaagtatcgctgtatcgatgcttaatagacagtttaaaacagctggcgatattatgtttttattgtcggtatcacaattattagaagactatacaagaaaaaaaacaactttacaattaaaagaatcattatcacttcatctagataaggtttggatcttagaaaatgagtcagaaatagaaattcctagtgatactctaaaaagaggtgatatagttattgttcacatggggacgatgatccctgttgatggagaaataaccgatggtcaggctttgatcaatgaatcaagttttactggtgagcctctaagtaaagcggttggtaaggatgatactgtttttgcaggaacaattgtagaagaaggaaaaatttatgtaaaagttagaaatctacaaaaagaaagtcgtattaataaaattgttgatatgatcgatgttaatgaaacattaaaagctggtgttcaatcgcgagctgaacatcttgctgattcgattgttccatttagtttttttggcttctttggattgctattatggacaagaagtctaacaagagcgacttcaattttattagttgattattcgtgtgcaattaaattgactacatcaatttctatcatcagtgcaatgcaagaggctggaaaacattcaatcatggttaaaggtggtaaatatcttgaagcgatggctcaagccgatacaattgtctttgataaaacaggaactttaactaatgcgactccattcgttcaagaagtaacaccactagatgactacagtcgtgatgaagtacttagaattgcagcttgtcttgaagaacatttccctcacagtgttgctaacgcaattgttaagcaagcccaagatgaggaattgttacatcaagaagaacatgctgaagtagaatatattattgctcatggtattgctactaatttacatggtcaaagagcaattattggtagtgagcattttgtttttgatgatgaacagattgaaaaaccccctgaaatagttcagttgatcagcaaattacatagtaaaggagctagttcattgatttatttagcaataggtcaacgcctagcaggaatcattagtatttatgatccgctcaagccggaagccaagcatgtaattaataatttacgggagattggttttaaaaaggttattatgttaactggagattgtgaaaacgctgcagggcatattgcaaatgaactaggaatagatgattataaagctggtattttaccagaagataaagctgagtatataagacggttaaaagcgaaaggtaaaaaagtcgtgatggtgggtgatggcgtaaatgatactccggcactatcaagtgcagatgtatctatttcaatgcaagatagttccgatattgcccgtgaactagcagatgtgacattgacttcaagtcgtttggatgaaattgttgaatttaaaaagatttcgatattactaatgcaaagaataaaacataattatactaatatcgtggcatttaatagtttattaattttatctggactaattggattattacagcctaatacaagtgcatttttacacaatacttcaacattcctattttctgctgtctcaacaaaaccgcttctttataaaaaagaaaattaagcaagtagggagatttccttacttgcttttataatcaattgaattataagataaataaatgtctatactataaaaaattaataaatttaagggagaagtggttatgggagaagcactggaagattatttagaagctattttaattttatctaatcaaaataaagccgttcgttctgttgatttagcagtgtatcgaggatattctagggcaagtattagttatgcagttaaagagcttagaaataaaaattatttagaagtaaataaagatggtcatctcaagttaacatcgagtggtcaagtacttgctaatagaatttatgaacgacactgtttttttaaaaaacttttaatcgctgctggcgtaagttcaaaccaagcagaaatagaagcttgtaaaatggaacatggaattagtgatgacagttttgaaaagttgaaaacgttgttagatttttagcatggaatttttgtttgagtataaacatagatattgtaaaaattgattgaatagaaatttattaaaaaaatgctgttaatatgttttaaaataaaaagacaaaatcaaatatttttggttttgattttatccgttcatttatctgaattttaatggtatatatttttataagaaaatttcgttatttgctgatttcagcataaatgtgtaattgatgtagagaatgaatataatcattaagcacatgtaatcttagttgtgtatcaactggtaatgataaaaaatattcgcgagaactagaactgcgctggattaattcatgtaagttttgatatttaatgtcactcacctctaaacatatcatagccgttattgataaaaatatacaggttcaaaaacataatgatttaattgcataaaatagaaaaggaaatacaagcatattaaaattgcacgttgctagaaacattcatacgtaacaaatgtattttaaattatcctttattatctataataaaaaagagaaaaaaataaaggtgattataaaattaataaggaaaagtatttcaatagctatgcggttgaatccaaattggataatactgtttaatagtagaaagaataatggagctataaaatcaacaacagctgcaaagtcatgaattattgcttcaatcgtatctgggtcttttgttaatactaaagcattcagacaggagctcgcctccaaaggataatatcatgatggataacaccattagcgatacaataggaaatgagaaagattttaaaatgataaaaaatctaatggtaatataactaagaaaaattctaagccaaatcagctaaaaattataaattctttttacagggtctttagaattttctaatataccttattatcataaatctacttttacagctagaataaaatgattttaagatttctggtaataaaaattcaccaaaatcattattaaaagaatcaactaagtaaattgatgtataggtagtttttcataataactcatcactttatttaataattatattattttgttgattaacttaataaacaataaaaacatgacataagtcatgtttttattggctccagcctttggtattattacggacattgataaaatcttggtatattccagtttgtttgattaactggttatggcttccgctttgtgcaatttttccatcagctatgacaagaatcttatctgcgtagcgaatagtgtttaaacgatgtgctattactaataaggtttttccttgacataactgtgtaattgcttcttggatataattttcgttatcaccatcaatactggaagttgcttcatcaaggataataataggagcatcttttaaaatacatcgagcaattgaaattcgttgtttttcaccaccggaaaggcttgtaccaccttccccaataattgtttgaaaaccatttggcagtgccatgataaaatcataacaccgagcttttttagctgcttcaatgacttctttttccgtagcctcaagtcgtccgatgctaatattattatagatagtatcctgaaataaataaacacgttggaaaaccatactgatatgattcattaaatcagcaagtttaacgtttttgatatttgttccacggatgtttattgacccgctatcaacgtcccaaaaacgtgttaatagattagcaatcgtacttttaccgcctcctgatggacccacaagagcaagcatcttatttttttctaatgtaaaatttatattgtgtaatacttcttttttatcataagagaaactaacatttttaaattttatttctggtagatcactttgttctggaattacttccataccatcatcaggcagttctttttgagctaagacatcttcgacacgatccatacaactactcattacagttaaccgtgtactttgactatacaacgctttaagtggaccaaataagtcaaatacaaataaagttactccaatcaagtaaggaacagttagtaaattttgagtttgtagatataatgagagtgctaaaatagcagctattcctaaaccataaataatatttagccaacgttgccagggagcatgtgtttcttcaaattctaaattagttcggcagctctctttaaaattattagaaagttcagctgatttttcacctaacagattataagttttaataatactaataccctcaataaaatcaagtacagcattagtgagtttttcactttgttcttgtctgatagttgaatgttctaatgtttgttgttccatcgctttacctaaccataggattgctccagcaattaacaatgaaagtatccccaaccaaatatttaaatagaacataaagatgatcataataatttcagcaaaaatatagctcatcatgtcagcaatcacggtcatacaattttcttctataaagaccatatccgtagataatactgaactaattttcccaatatttccttcagtaaagtaacccattggcaattttctaagatgacggcctaattccatgcgcatatctgaaaaaattcgataaccagaatcaccttgtaaacgatcagaaatattttgaaaaactgcttgaaataaaacacaaactattaatgtaataccaagcagaaaacataatcgatcagacattttattattataaaaagcattaaaagcaataaatgctagtccgattggggattttgctaacattgattttaaaaacgagaaaataaaagcgattttaatattgcgacgatattttccggcgatagcaaggattcgtgacattaatgagatcataattaattacctccttgattatgactaactctccaattagcactattatttgccatggtccataacttttggtattcaaggcaagtatctataagttcttgatgagttcctactgcgtttaaatagccatttttaagtacacaaatctgatgtgcattgataattgaatgtagatggtgggcaataacaataacagttttatctttgataacttctgcaattgcggcattcattttttcttcattttctggatccataaatgcagtagcttcatcaagaacaatgattggagcatctttgagaattgcccgagcaagagaaattctttgtcgttcaccaccggataattgttttcctccatcacctgccaaagtatgaattcctaattcaagacggcttaaaaattcatcacactgtgctttactagctgcttgataaacttcttcatcactagcatcaagccgtcccattctaatattttccatcaaagttgtattaaatagaaattgttcttgtgatacataggcaatttgattatttaacgtttcaatgctcatttgtcgtaaatcttgatttccaattttgatcgaacctgaatggacatcataaaaatgaacaagcagttttgctaatgtgctttttccacttccagattccccaatcaaagccgttagtgagccttctttaatttctaagttaatattatgtaaaactacattattattgtatgcaaaactaacattatcaaagctgatatgatggtttctgtctttaaaacaatcagatgtttgttgtagtggcggtgcacttaacattttttcaagagactcaattttataactgatttgtggtaaagttgagacaaacgccaaagcccgtaaaagcggagtaccaattgcgaatgataagcaaagaataagaactaagtcaggtaaactcgaatagttgtgaagaactaaccaagatccaaatggtagagtaagtaaagctacacatggtaaaatactattatagagtgccatccatggccaacaagctttgtaccaggcaagagtgaaatcacgatatccacgtatatcattttcaaaacgatgatatgattcaccatcgcgattgaatactttaacaacttccattccattaacatattcaataatagtattattcattttttgtgcagatgcgtagtaattactcatttctttcataccaattttgaacattgcccccatcgctaataaaccaatgggaagagaacctaaagataataaggcaagtttccaatcaacaataaacataacaatatagatgaagaggggaatagctaagttcgagatcccttccggcaaagcatgtgccaatagtagttcaattgcttcaatatcatcaataaaagtttttttatgagctccaactcctttttcttgaataactcctaatggttgcttttcaagtttgcattgtaaagaaattcgtagattttttaatgtgtgatatgcactttggtgtgataaggcaagacctttaacataaaaaacggcatataagataagtgaaattgcaatggcaataactctaaaaataatataatgagtgcttatttgctgatgcatgattaaaggtgtaataatttgatagataaaaagaaatggtaagatattcattcctactccaatcagcattgtggcaatagcttgataagttttttttcgataatcaccagcgtattctaatacttttttaagcatgtaatcccttctttctggttagttttagctaacctaagttttttttaaaactcccatctagggagtttaacgtgtatatccaagaacttggtaccagttaaagaaatggcagacaatttggcaatgattctctatttgctcccaactaaaaccatggatgaatggctcatagatcgtagtccaaaaagaagatagtagagtatgaaattccgttttactgatttccgtagtaaaaattcctcgatttttagcttcaagataatattcataagtatagatggacattttttcaacccagtcgtgagtaaaattagaaaaggaagtaccttgtgagcatgatagtaatagaataaagccatcataatggctatataaaaatttaaaccaccataacattacatcgttattcatattccaggcttcaattaattcaaattctgtaactgtttcaaaattgatcctacggttgtcagcgacttcatttaaagcttctaaagtaggggtaactactgctgtaaataattcctctttacttttatagcgtttgtaaagtgcccctgtagtaacctttgcatttgcacagattgttttcaaagaagctttctcataaccttgtgataaaaattcttctttagcactttttaaaattcttggatcaatagatttatcgggttttgacaatttatcgcctccttttatactgataattaaattatcgataatctaattatcagtataaaagtaattgcacttgatgtcaatcgttacaataaaattttaggttgaaagtaataaatttgtttttataaaaatttaattggaataaataaaaaagccaacttttgaataatgtataagttgactttttgaggattatttaatttagaggtatttcaagtatatgtgctttattgatgataacgctttaaaagaattttttttaaataagctttaatatagaaaattaaacttagcaataatgctaaaaggatcaatgtttcaatcataattaaacagtaactagttttttaccctgatcagcaacagcatcgatcttctcttttaataacgtttcatcacctaaatagtaatgttttattactttaaattcatcatcaaattcatatactaaaggaattccagttggaatattaatattcatgattgcttcgttacttaacttatcaaagtatttaaccaacgctcttaatgaattaccatgtgcaacaattaaggctcgtttaccagcctgcatatctttttttactgtttcattaaaataaggaataacccgctcaattgttgtttttaagctctcacctgctggtaaaagagcagagtcaatatttcgatacattgcctgcttttgcgcgctgcgtttatcatttatatttaaagctggtggcagtacatcaaatgaacgacgccaaattttcacctgttcttcaccgtatttttctgcagtttccgctttatttaatccttgtaaagcaccataatgacgttcgtttagtttccagcttttattgacaggcagccagcagagatccatttcatctaatatatgatttaatgtgtgaatggctcttttcagataagaagtgtagcatacatcaaattcataaccttcattttttaaaatcgtgcctgcttgtattgcttctcgatggccagtttggcttaaatctacatctgtccatcctgtaaaaagatttaatttattccagtcactttctccatgacgtactaatactagtttcataatatctctccttttagttagcttaagctaactatatttgtataatattccaatgaacaaaatttgtcaactaagatgataataaaagcaagctgttacaatatttttcacaaaagaattaatctgattttactgactgaaaagattaagatttcatttgaaatgatttttagttataataattttataggcttgagaagttagagagtgagggaatggttatagtaacagcaagcactgatgtggctttttgattatcaatgaaaatatatataaaaatatgataatattttagtaacattggaaataaaaatgccggtatcgattaatattgatgaaagcgacttttcaacttttgaaaatgctggatttaatattaaaaataatgatatattagaaataatgaaagcgatttaatgaggtaggaaaatgagtagagtaaaaagtttaaatatcaagtatgtagccagtcaagtattttattttgcaacctttgccgcaatgatgggatatgcctcagtatacctattgcacaaaggttttagtaattcaacaattggtataattttgtccctatgcaatattttagcggtgttcatgcaaccggcattagcaacttttgctgataagaatcaaaagattgaaattcgtaaaattattacaactatcgttgcaatagcaattgctttatctgcaattttattagtagttccaagtaatcaggcaattatttttattttgattgtatcaatcttttcattaatgacaacgataatgccgctaatgaatactttggcatttgtttttgaaaagtatggaattcaagtgaattatggcttggctcgagggctggggtctgttgcttacgctgttgcatcaatggtattaggacatgcagttgatgcttttagtccggatttattaccagtatgttatgttgtctttaatgcactattatttattgttgttcatggctatgtattgccaaaaagtgaacaaatcgaagttgcagttgagacaaatgacgaggatgaagttgcagtaaataatgaaggtttgctaagatttgctggtaaatataaaaaatttattgtatttttattagggtttgtttttgtttattttgcccatacaattattaataatttctttatccaaataattactaatgtaggcggtaatagtagtgatatgggaaatgctgtatttttagcagcgatgttagaattaccgacaatggcatattttacgaagcttagtaaaaaagttaattgtggaacgttaattaaaatttctattattctattcttagtaaaacatgtgattacttattttgcagatggaatgacaatgatctatatagctcaagctttccaaatgggggcttatgctttatttattccggcatctgtttattatgtgaattgtaaaattgccccacaagatatggttaaaggtcaatcatttgtgactacttcaatgacagtagcaggggtttttggtaacttgattggtgggatgttactagattcagttggtgttagccaagtactgttaattagtgctgttctatcattaataggtgcggtaattgtagtaatgtctgttgaaaaagtataattttatagaattaatgaaagtgtcggtttagttatttaaaatggtgctttaaaataatatagggtactaaacaaaaagctttaacaaaaagtagggttagaagatgtataatcttcaataattatcctacttttttatgtctagatatagtattatttcattttttatttgtttttgtttttcttgatttgttttttattaatagaaattgtatacgtatctaaaagattctgagaatacataattctatttctagctctgtcaaaattggtcattccatttacattagatagaatcttttttacataattattttttccttcaatacatccgttagatattcttcttcattatattcattttctttaacatcattaaatacacgataatcttcttttaaattataagccatttttaattctttgtttatagaaagaacacattctaatactcctgcttcactagttgtataacctaatgtacgatcaaaaaagtacttttcatcatttattttatcgccactctttaaaagcagttcgtatctatattttaataatttgtattcttgactatctttgtaacgtcttaatatccttttcctaactgaatttagacaatctgtaatcttctttaaaatatggaaactgtcaatacatattatagctttaggaaaatatagtctcattaaagtgcggtaatgattatacatatccatagaaatgtattttactttatcacgttcactcttaggaatggagaagaaataatcattaagtttctcttcacatctagattcaacgatatctaggataagttagtttttgaatcccataatcataaatgcatatttatatttagaacgtctgtcgaaatagaaatcatctatacatatgatttcttgtaagtggtgtctttttaattgaacatgattatcaaatattcttactactgttgaagggctaacgttatagcatttggcaatagatgagtaagtagctgtataatgtttaagatcatttaatatagaaattaatgtaacatttgtaatagaactataactcttatcaaaagaatttggttcattaaatgttttccttcagtaaggacatatcattcttcttaattcgtaattaatatatgtatcagtagcatttatgatttgataaacatattttctttttttatattcttttactttagaagttagtttaagacattgaggacatctgcaaggttatccattaagatgtacatataacaatatttgtggttgagtttcttactgtctcaatgttctctacctcttcttgttttaaatctaataaattaatgataaaatttttgataagggcttctctggttatacttatatctagacaaaataattataacaaggaacccttttaatgttgaaaaaacctacttatgttaaagcaagaaaatgaaaaaccctacaaaattttgttatacctttaaaatgctagatcaacactgtttatatagaaaaataaattttattttaataatataaaataaaatctaattaatacttaagttactttgatatttatgttagaatcttaatattgcgaataggaggaaatatatgagtaaagtaattaagttaggcaattataaaggaatcgaggcagaagtaacaaaacaacctgttgctgatacagaggtagataatgagattcaacgtttagttgctcaaagtacaagtctaatcgaaaaagatggtgatgttactaatggcgatgtaacaactattgattttgaaggttttaaagatgaagttgcttttgatggtggaaaagctgaaggttttcaactagaaatcgggtctggtcaatttattcctggatttgaagaacaaatgattgggatgaaaaaaggtgaaacaagagaattaaatttaacttttccagaaaattatggagctgcagatcttgctggagcagatgttgtttttaaggtaactgttcataaaattgaagagaaaaaagaagctgagttaaatgatgcgtttgtagcatcactaaatgcacctggaatcgaaacgattgatcaattgcgcgataatataaaagcatctttagaagcccaacatgaacaggcatttatggctgctaaagaaaatgcagcattaggaaaattaattgatgactgtgaagtagaagtagaggaaagtgatattgaaaaagcgctgcaacaacaacttcaacatatcagtatggaacttgctagtcaaggaatgcaattagaacaatatttacaaatgatgggaatgaatcaagagacattattacaacaattagcaccttcagctaaacaacaagcaacttttgaagccattattgatgaaattgtggcgattgaaaatttagagactagtgatgaagaagcaaatcaacaagtagaagcaattgccgcacataatcaagtgtctaaagaagatgttttaaatcaaattgatattgaaagtttgaaacgtgatttaaatagaattaaagcaagccgattaattatggataacactgtttttattgaagtataatagaaagaattattgatatctttattaagatatcataattctttttttataataagtatgaagattgtacagttacttaatccaagatgaaaaataattgttataattagaaaaagttgataatttaaatcgagggttatatgaaaaaaattttaattagtattattttatgtggatgtaaaacagctgtgagtcgagaaattaaaacagaaacacgatataatcaaattgaaatcaatgcagctatggatgaaattgaaatggaatttgcaaattgcaccttattggaattatcttttgatgaaacaaatgagcaaaatcaaaattttgatagtgggaaaattattgtttatggtaaaatcaaggttgacgagacaattggtatcgaaaatttagagattaacagtatttgtgataaattttttttaattttggaagttaacatgcatggtgagtggaaaatagcaagctatggatgttgaattctaggaactagaagtatttaggaaagtaaaaacgataataaaggaggaattgatgatgcaacgtggtattttaattacgggtggcgctcatgggattggaaaacaaatttgtttggattttttaaggcaaggggataaagtatgtttcatagatattaatgaagaggcatcaaaacgctttgaaagtgaatatcatgatttatactattattacggtgatgtagcaaatccagatacattgaaaaattatgttgattttgctaaaaaaaggttaggacgaattgatgtattagttaataatgcctgtaaagggatgaggggaatattatcggatattgattataatacttttgattatgtactttcaataggtttaaaagccccttatgaattaagtcgattgtgtaaagaagaattaattaaaaataaaggaaagattattaatattgcttcttcacgagcgtttcagtcagagcccgatagtgaggcatatgccagtgcaaaaggtggaatcgtagctttaacacatgcattagcgatatcactgggtcctgacgtattagttaattgtattgctcccggatggatcaatgttgatgaaatagaaaattttggtgaacttgataaggcttctctaccggctgggaaagtaggaacaccaaaggatatttctaaaatggttttatttttatgtgggcaagattttattaccggagaaacgattacgattgatggcggaatgaacaaacggatgatttatcatggtgactggaattggcaatatcatgaagaataaaaaatagtagtatactaatttttgttattttaattttaaagctaaatataaaatattagcatcacgaaattttcgtggattataaccacataatttatggatacgatctaatttatactgtaatgtatttttatggataaaaagacgattagcagtatttaataaggacatatcctcttcaaaatatatgtgtaataaatttaaatcttctaatgataacattgcaattgttttatttagatagtcttttttgtcataaatggatattgattgaagaataatttcaagtgttaacacatcatagttaatatattgatggtcttgaatatttcttagagcaattaaggcagaatgataagattcactaagttttattaaaggaatttgtttaccaacagctattgaaacctgattaccggcaagttttttgagcttatattcacatctattaaagtaatcagcatctattattgctagaaaacgattggggtactgatagtgatataccggaatggctaagctatgaagttcttggataatagactgctcatttacgagccgttttgctaaaataatcaaaagacgataattgttttttaaatctaactgaaaatattttaacatatctgaaaaatattgggagtcaaggttttcttggtccagtaatgattgtaacagataatgcattttttcagcctggctacgattaaattcattcagctctttttctcgaattaatagatttgtgattttttgtgctaaataggcatatttttttactttatcaggtttaccactgattccaataacagcaataatttgatcgtggtaatagactggtaaattaactccctgaagactaccattaaaactagtatcatcatacacttcgataattcttttctccttgatggctaaaagaccagcttcatggaaggaaccaattctttttatatctgtactggcatagataattccttgacaatcaataaaattaatatcgtggtcacaaatatctttaactgtttcaacgatttgagtagctaattggttattaatatacatataatcctcctttggtataagtactaaataaatatgcattttatttaaataacatgttaattataacatattatttataaaaataatttgttatattataactaagaaaaacaagggggataaaataatgaaaatagttattgcgatcgattcgttaaaaggaagtttatcttcaattgaagctggagaagcaatcaaagcaggaatagagcatgtatatgatgatgcaaaagtaatagtaagcccactagctgatggtggagaaggaacggttgaggcattaaccgagggtatggatggaaatatgcgttctcttgaagttacggggccattaggcactagagtagtttgtcaatatggaattattacagaaacgaagacggcagttattgaaatggcgagtgctgcaggaattactttggtagctccagatcagagaaatcccttactgacaacaacttacggtgttggtgaaattattgctgatgcaattacaatgggatgtcggcattttattatagggattggcggtagtgccacaaatgatggaggaataggaatgttacaggcactaggttaccgttttttagataaatatggaaatcaagtaacatatggagcacaaggactggaacaattagttgaaatcgatgacagtggggttgtttcttcgttgaacgagtgtacttttaaaattgcttgtgatgttaataatccgctatgtggtaaactagggagtagtgctgtttatggaccgcaaaaaggggcgactgctgaaatgataaaaaaaatggataaggggcttaatgattatgctaaattagcgaaattaaaatatcctaacgctgatccggaactacccggtactggagctgccggtggtctaggctttgcatttttgacatttttaaatgcacaattagaatcaggtattaaaattgttttagaagaaacacgattagaagaatatataaaggatactgatattgttattactggtgaagggcgtcttgattttcaaacagccatgggtaaagctccaataggggttgctaaattagcgaagaagtatcataagccagtaattgcttttgctggaagtgtgacagcggatgctaatgaatgtaatcaccaaggtatcgatgcttattttccgattgttcgtggtgttacaactttagaggaagcaatggagagcagtaatgctaaaaataatttaatagctactgttgaacaggtgtttcgtttgtggaagataaaataagatgatatgataaatgtatataaaatttgttcaaaaaggagcgatgggaatgggaatctggattaaacagtagcatgcagggctttactgtttatagccttgctcgataaaaaattcaggaggcagaatatgatatattttaaatacaagaaaaaaatgtttattgtcagatgttaggggaagagtaaccgctattgtttttgcatggaaatacagcatcagctggagtgtttgaataaattttatcactatatcaagatgagtataaacttattttaattgattttttaggacatggtaaattacagtgaatagcgaggtttcctactgacttatggtgacaagaagctgatcagctaatcgctttattagaatccttaaatattaaagatgttactttaatcgaaacaagtggaggtgtttggggtgcagttaatgctgcattaagacgctcagatttaatcacttgtgtagtggcagatagttttgatgggcgaactcttcgtcggggatttgccaaagcattaatcgaggagtgggtcatggcaataaacaatcttgcagcaagacaattttatcaatggtgtcaaagtgataattgggagactttggtgaatcaagatactgaggcactgttaagacgaattgatttgggtttaccgtagaagtacctttaaatactttaaaggtactattgttgttaattactagtgggaaggatgcgatgttacacagtgatatcatagaagaatatgaaaaaattatatacgagcatccacctgttaaaatgattatctttccaacgggtaagcatccttcgttattatcaaatgccgtggcagcatccactgctataaaagaatttttgagcagtagtaaacaaaggagttaactcctttgttttagacttcagttaataaaaatagtatttatattataattacaaatgatatactcatattaattagtaaaaggagaaacagaaatgataaaagcgatattttttgatattgatggaacactagtgagttttaaaaatcatcaaatacctgcctcaactatcgagtcgttaaaaaagctaaaagaaaagggaatcaaaatttttgttgctacaggacggggaaaggatggtttagatattttagatgagattgagtttgatggctatataaccttaaatggtcagtattgttatgttgataatcaaataatatatgaaaatacaattaaacgagatgatttacagaaacttttgaattatttagaagaccatccttttccatgtgggttcacggaagaacataataaatattttaatcttcgtgatgctcgagttgatgaaattcatcgcattactttgaatgatgatcatccagctggtgattgtagtgatgtagttaataaaaaaatttatcaatgtatgtgctttattgatgagcgggaagaacaaaaattaatgcagattatgcctaattgtatttctgcgcgatggcatccacttttttgtgatgtttctcccaaaggaggaacaaaacaaaatggaattgataagtttttagatttttaccatattgatcgtaatgaaacaatggcttttggtgatggtgggaatgacattgagatgttacaacatgtggcattatcagtggcaatggaaaatggtaatgataaagttaaagaaattgctgattatgtgactgctgatgtagacgaagatggaattttaaaagcactgcagtatttcagtattctttaaaataagatgatgacttatcattaatgatgaaagtgatatttcaagggagtataatattgtttgtaagaggtgattaaaatggatgaaattaaagtgccttcaactagatatcataaaatagtaaatcttctttgtataataatattgacaggaacactagtctttttggtaactaattggacgatgatcccggatcaaattccaggacattatgatagtgctggagtaatcaatcgatggacaagtaagtcagggctatggatagtttattttgttggaatcataatgtttgcgggattatcagtaatagaacattttcctaaaacgtggaatactggtgtagctattactaaggaaaatcaaaaacatgtttatcaattaataaaaggaatgatagtaaccctgaaattatgtatcaccacaatatttatgtttttaacactgtatacgactttgatgattaatttgccaaaatggtttacaccgctttttctaattattacatttggttcaatgatagtttatggtataatgatttatagagctcgatgaaattacctaataattaagggtgtattaatctcttattaaaaatacgaaaatgatatttgtttttaataataaattgaactatcgcttttaatagtgttcttctgtaaaaaaattatttccgtgtctaatacattttttttgtacaaaaataatatattgatagcattcctttatattttatgtcttttctgtagacgatagtttacagaaatatatccttttattataaataatggttgacctaaagttcactttaggtagtacaatgtattttgaggtggtaaaagtgaaatatcgggaattaggaagaacaggtttaaaagttagtgaaataggtttaggctgtgaaggatttatgaaaatggatactgatcaagttaagaaatttgttgctcaggcttcaaaaatgggaataaattttatagattttttttcatcaaacccacatgggcggagtgcttttggtaaagcgatagctggtaaacgtgaaaagtggattattgaagggcatatatgtactttttggaaaaatgaacagtatttgagaactcgtaaaatggatgaagtaaaagctgggtttgaagatttgctggcaagactgcagactgactatattgatattggaatgatccattacattgatgctaaaaaagattttgaagaagtttttaatggtgaagtaattgagtatgtaaagggtttaaaaaaacgtggaattattaaacatattggaattagttctcataatccacttattgcaattgaagctgttaagacaggattagttgatgtaatactgttttcaattaatccttgttatgatatgttgcctccatctgaaaatgttgatgatttgtgggatgatgaaaggtatgcggaaccgctttttaatattgatccagtccgtcaagaattgtatgaattgtgccaaactaaaggagttgcattaactgtgatgaaagcatttggagggggagatttattagatgaaaagttatcgccgtttaaggttaaaatgacaccgttacagtgtattcattattgtttaacgcgaccgggagtagcttcgatcatggcaggaagtcatagtattaaagagatgatggaggcattagcttatgaagatgcaagtatggtagaaaaagattttgctaatgttttagctaatataccaaaacattcatttgaaggaaattgtgtatattgcggacattgtgctccatgtgtcaaaggcattaatatagctgatgtaaataaatttgcagatttatgtgttgctcaaggggaagtaccagaaacagttagagaacattatgaagttttagctcatcatgcaagtgaatgtattgaatgtggggtatgtataaaaaattgcccattcaatgttaagattattgaaaaaatgaaagcagcagtagcaatttttggttattaaagctattgcgtgaggaaacattatggttgaaaagtttgatatagtaatcacacaacttggattagagcgaacaatccatgtatatttaccagaagattattatgatagtgatgaacaatatccagtgatgtatatgtttgatggacataatttattttatgaccatgatgctacttatggaaaatcgtggggactaaaggaatttcttgatacctatgataaaaagttgattattgtaggaattgaatgtaatcatgaaggacaaaaacgcttaagtgaatattgtccctatcaaatagaaagtaaatattttggtcatctcaatggacaaggaaagatattgatggattgggttgttaacgaattaaagattctcgtcgatcaaaagtatcgcacttatctgtttcgtgaatgcacaggcattgctggaagttcaatggggggattaatggcgttttatactgttatttattacaataagtatttttcaaaagcagcttgtatatcgccatcgatttcaatgtgtatggaagaattgaaaaatgaatatactcaagctaaaatcatggaagatacgcgggtatactttagttttggaactgatgaggtcaaagggaaaaatgggattcaatggatgttgaataatatcttatattttaatgatagactgattgaaagtaatgcatctagttatataaatgttgtggaaaaaggtcagcataatgaagcatcctggcagttagaaaatcaaatatatctagattatttatggaaataaaatatttttttagtgattgcgattgcagataaaatatattaaattaaggttatagctaagcatggttgaaaccatgcttttatttttgattttacctaatatggcttgtgtgatacaattattaaagataccaacaaaccaaacagaaataatcatttatagggataaaaaaatgaaacgaaaaaagagaaaatttgcgataaatgtaatgtcgttagctgtaataccgatactgattttaggaatgtttgtaatctttataacctcaagtttaatttatactgccttaaagggcgaagttgctaataatcttgaagatttggctagagtatcatatcaagactttgacatgcaatatccaggtgattattacttaaataataaccatttatataagggaacagaagatattcaaaatgattttaatttggtggatttaattaaaaataataccggggtcgatgcaactttgttttatcaagataaacgcatactaacaacaattcgtcaagaagatggcaaaagagttgttgatacgattgcaccagatgaagttatcgaaacagttttaaataatgataaagaatttttttcagattctgttgtaattaatgatagtagttattttggtttttacatgcccgtaaaaaatactgatcagcacgtcgttggaatgctttttatggggcgtccacgtgctgatgttatgaatcatattatgcataatatttatcttgtttctctttcaatcgttacaattatgataattgcaattattgtatcttattattatagtaaaaaaacgatttttgctttaaatacaacaaaacattttttaggagcagtagcaaatggagatttgacgactgaaatagatccatatgtattacagcgtcatgatgaaattggtgatatggggcgttttgcggttatgatgaaagagtctcttagtgatttagttggaaaagatccgttaacgggattacataatcgccatagttgtgatgtggttttagcgagtttaattcagcgtgtaaaacaaaagaacacttcttttgcagtggcaatgggagatgttgatttttttaaatatgttaatgatacatatggtcatcaagcaggtgatgaaactttacgtcaacttgctaaagttatttcgacccatatggaacacctgggatttgtatttagatggggtggtgaagaatttgtcttgatctatgaagatatggatcggtatcaggcttttaagcatttagaaatcttacaagaacagatttatcaagagagtatttattggaaagatgacaaagttaagattacaatgacatttggcttagcggattctaatgaatacaatgatcttgatgaattgatcaatttaattgatgataatctttatcgagggaaaaaagaaggtcgtaaccgaattgtttttaatactttaaaatagaaattaaaacatgaccgttaagataattttaacggttttttagataaagatttctaattgagaaaatatctttaatgtttcaaaagattagatacaatagaactataaactttattaaaggtatgaggtatgaaaaatgataaaattaattgtatcagatatggatggaacactattggcgcatgattcatcaatttcaaagggaaatattgaagcaattaggtatgctcaaagtaaaggagtgcaatttgcaattgctaccgggcgtgattattcaagccttaaggggatattagaggcacatgatttaaaatgttttagcattttaggaaatggagcacaattttgtaatgaaaatggagaaattttatcaagtgcatattttcctaaaaaatgttttaaacaagttttacaaatatttgatgaactaaagattcattatatgatttttactgcgaatggtttttattcaacagctgagccaaatgttgttcgtgatgcttttattgatcgctgtgttgttcagttcaagcgcaaacgagaggactacttagatgatggctgtaatcaagatatggcgtgtatgaagttaaaaaaaataggtgacttagatgattttattaattcttcaattgatattattaaggttgaagcatttaataatgatgtatcattaattgaaaaagctaaagaaaaacttcaggaaattgatgggatagcttatttatcatcatttgatgataatattgaagttaccgataaggcagctcaaaaaggattgattttggaaaatgttattgaagaattaggttattcaaaagatgaagtaatggttttaggtgacggtctcaatgatattacattatttgagcggtttaagtattcttttgcgccaggtaatgctaatgagacaattaaagcaatggcttatcaggtagttggagcatgtgaagaagacggtgtttcccaagcaatctatatgatgttataataaagaggattgataagatcttctttttttgatgggaggaatttaatgatagaaattaaatttttaaaaagtacggatgaatattgggatacaatgattgactatgttcaaaattgttcttggcgtgctggtaaatctttggctaataaaatgaagacagggtattttactaaatggcagtgtgtagttggggtttggtatgataataaaattgttggtttttcgacttttgttgaaagtgatagtatagataatagtggctatcagccttttattggctatatctatgtgaatccgaattaccgtggtcaacgtttaagtgaagtgatgattaaagaaattattgtatgtgcaagaaaaatgggttttaaaaaaatatatatacatagtagtgaatttggtttatatgaaaaatttggatttaaaataattgattgtggaaaaacgtgttcgggaagatatgaaaatatttatgaaaggaagattgcttaatgattttgtattttagcgggactggaaatagccgatatattgcagaggtaattaattcagtgattgaagataaattagtttctatcaatgaatgtttaaaaaataatttaattgtttcattagagcagcagtatattattgtttgccctacatatgcgtggcgtattcctcgggtagtggagcaatttattcggactaatcattttgtttcgggaactaaaatttattttataatgacatgtggtggagatattggaaatgctgctaaatatattaaccgtttatgtaatgaaaaaaatatgattttaatgggagtcggagagattgttatgccagaaaattttattactatgtttaaggcaccagaaaatccagaagtgattatttcacatggtgtagaaactgcacttttactagcagctgaaatcaaagcaggaaaatattttttagaaactaaacctacgtttataggacgatttaatagtggcatagtcaataggcttttttatccaatgtttgttagggctaaaggatttcatgttgaagatacttgtattggttgtggtcaatgtatccatgcttgtccattaaagaacattagtctagttgattctagacctatttgggatgaacattgtacacagtgtatggcatgtatcagtatttgtccaaaagctgcaattgagtataaaaataagacaaagggaaaaagacgctactatcttaaagatagttataataaggaaattaaatgaaaattgtaattactccagctaaacggatgaacgataatattgattatatagacgtagaaagtttacctgtttttttgccacaaacggaggaactgctaggaattcttaagacactaaaagtcgatgaagtaaaaaagatgttaggttgcaatgatcaaattgctcaaattgcatacttgaattatcagatgatggatctaaaaaaggacacagttccagcactgctagcttatgaaggaattcaatatactaatacggcagctcatgttttaactgatgatgattatgaatatacaaaacaacatttacgcatcttatctggattttatggtattttaagaccgttcgatggtgttgtgccatatcgtttagaattaaataataaagtaaagacagaaaaatttaaaagtttatatgagttttggaacagtcgaatttatgatgaattgacaaaagatgataatcaaatactagatcttggggcaaaacaatatactaaaatcataaaaaaatatttaacatctagcataaaatatgttaaatgccactttaaagaggagagtgatgaagggtatagggaaataggtgtttatgtaaagatggcaagaggacaaatggttcgttatttaattgaaaatcgaattgattcatttgaggcagtaaaacaatttaattatttaggttatcaatattgtgaagcattatcagatgtggaaacatatgtatttatacggaaaaaggggacatgatatgaaaacattaattaaaaatggaattgtgattcttgatggaattaaacggcttaataacggtgcggtgatgattgaaggtggaaagattacaggtatttataaagattatgaaggattagaagctgatagtgttattgatgttcaaaataattatattattcctggtcttttggatacccatacacatggggcgatgggatatgattttaataagtattcatcaaagcaggagttagaaataatcagtgatagcttattagatgagggagttactggttttaacgctagtattgtttgtgaaagccatcacgacacattgaatcttttacaaatgtatgaaggaaataccccagataatttaattggtgttcatcttgaaggaccgtatttaaatattaagaataaaggtgtaatgaaagaagaacatttacgtttagtaaattttgatgaatttaatcagtatatttcaacttgcagaaaagtgaatgcaatgacaattgcccccgagctgcctaatgctttagaattaatcaattatgcaagtaaccatggctatgtgatgaatgtggggcattcaagtgcaagtgctaaagaggtaaaaaaggcacaagcatacggtgcaaaaggaattactcatctttataacgcaatgtcacagcatttgcaccgtgatcctggagttgtaactggtgcaattttatcagatttaatgtgtgagcttatcgtggatggctttcatattgataaagatgttattcgtgcgacatacaaagcaattggaaaagagcgaattattttgattactgatgctaatccctgtaagggattgccagatgggcaatatcatttttctggtaaagatattgtaattgtcgggggacatgctacagtcaaagaaactggtagaattgcaggaagcacattagggttaaatgaagcttgtgctaatatgatgcgttattgtgactgttcaatcgatgatgccgtactaatggcggcagttaatccagctaaattatatggattaaagcaggggaagatagaaattggttatcagggtgatattgttgtcatagataaagagtttacaatcttagcagttatcaatcggggaattataaaaagaaataagtttatttaaatatttagtgatttaacttgactttaagaagatatttgatagaatattattcgcggcaacgtctaggatatacgagtactcgacgtatagcttggagttagctaagttaaacaacaggaggataattagaatgttaactaaagcagaaaaaacagctattatgcaaaaatatgctactaaagaaggagatacaggatctccagaagtacaaatcgcagtattaacagcagatatcaacaaattaaatggacatttcaaacaacatccaaaagataatcattcaaatagaggattattaaaaaaaagttggtagaagaagagatttattaaaatatttaaaaaataaagatattgaaagatattcttctttatgtgaaagtttaggtttaagaaaataattggacgctttggcgtcttttttctttacaaaaaagctgaattgaattcaactcagcttttaagagagggttcacccttattttgaataagcttttttaatgataatcatgtagataaccaagaaataaccaacaaagagttgctgataaagaataaacataaaaaacgccatagtcaaacattccgccaataaattcactaacaacaattaatgtaaaaatcattatctttagataattggaactttgctgttttactttaaataattttagaatagatttaaatgaagcaataaaaaatattataaatagactcgctccagcgattccagttgttacaagagtttccaaaaagacattatgactatgaacaacctggatttgtttgacaacattactgttggtcaggtgcctaccaatagtttgaaaattaccggcaccaattcctaaaatagggttggtttgccaaatttcaattgaagtattaaataattcaatacgtccactgctgatctgattaatttgatttaaacttggctgaaaatctccttgaaaaaacaattcaattgattcaattactttattaatttgaaaacggctgcttgtttcgtgatgattaccacttaaatatgatagaccgttagcggtgatgatactagtaatgaaaataatgatagaaagacctaaagaaaatagatatttctttaactttgaataataacaatctttaaaaaaataagtatatattaaaccagtcaaaatgacagccaaaataactagagctgctcggcattgagtcaaaataatatataatagttggacaatgatatttagtttatataatcgtggatgtgtatattcgttttttaatgcataaagtgctaataaaatagtaattgcactcaaaaaggctgcaggattacaattaaaatatacaccaaataatcgatttcctactaatccgattggccatccattttgaattttcgagaatttaaataaatacattattaaagaacagattccagctagaccggttaataggttggtcagaggaataatactttttaattcatcgtagatattgtttgatgaaaaacttttttgattcccgtagatcaaaaaaaagatcattagctgtaaaagtgcaattaaatatgattttaaattactatatggattgatcgctgttgcaaggaacaaaatcaggccataggtaataattaaaataaatttaatatcatggtaattaatttgtttttgataaaagtcccatccaatgataagtcctccccatccaatcatgataaataacaaaatattaagattgaaacctaggtaacctagggcaagtgtattgataaaagcataaataataaatgctaatttaaaatattttcttgataatagataagtctgcataatccccctccatgatattcattctaacaaaatattgatattaatactactttaatttgtttgctgcgatttgcttattacaataactattaaaatagttaaagatagtgtataattaatgaagaatatttagaaatgagggactttatgaagaatattacattggttattatggcggccggaattggtagtcgttttggaggtggcattaaacaattggcaccagtaggaccaaatggtgaaataatcatggattattccatttatgatgctaaaaaggcaggttttaataaagtagttttcgttattcgtaaggatttagaagcagaatttgatgctgtgattggatcacgaatcaaacaaattattgatgttgaatatgtttttcaagaactagataatattcctgacgaataccaagaaacatttaaacaaagaacaaaaccatggggaacagggcaggcaattttatgttgcaaggatgtaattaatgaaccatttttagttattaatgctgatgactattatggtaaacaggcatacgaagaagcttataaatacttaaatgaaaatcatgataatacggctaaacaacagattgcgatggttagttttgtacttaaaaatactttgagtgataatggtggtgtaacacgtggggtgtgcacggttgatcaaaacaatcatctttgtgatattgttgagacacataatattgaaaaaggtgataattgtgcatttgttaaaaaagaaaatcaaattattgaacttgatctcgaggtaccggtatcaatgaatatgtgggctctacaaccagaaatatttgatattttagattctaagttcaaattgtttttatctcaattagagaatgataattttaaagatgagtatctattaccaactattataggttcactattaaaagaaaatcaggttgaagtgactgtgttaaaatcgttagataattggtttggagttacatataaagaagataaacaaacagttattgaaagtattcaaaaattaacagctgtcggtgtttatccacaaaaattattttaatagaaaccgaaggaagatgtgggtatcttccttttgtctttcatcagcatatactctttggtataattaataatgatatgaaaaacggggaaagtcgaatggaacaaattaaattaattgaaaaattattagaaataaggaaatataaggaaattaaagaaatcttaaaagaaatgaacgatgtggatgttgccgaaatgctcgaaggtttttctgatgaaaatatgatacgtatatttagattattgccaaaagatgatgctgcagatatttttgcatatatgtcaagcgacagagaacatgcgttaatagattcgttaaccaataaagagttagagaatattattaatgatctttattcagatgacgtaatggaacttcttgaagagttacccgctaatgttgtgaagcgaattattgctgcttccaatcctgagactcgtcgtgatataaatcatttattacgctatcctgaagattctgcaggtagtaatatgaatatcgattttgttgatttacgtgcagatatgacagttaaggaagcgattgcacgaattagacgtattggagtagataaagaaacaatcaatacttgttatgtaatcgataattttcgtcatcttttgggaattgttactttgagaaagttagttttatcatcacaaagtgctttgattgaggagattatgaacgataatcttattacagttcatacgatggaggatcaagaggatgtagcacatgattttcaaaaatatgacttaacttcaatgcctgtggttgataatgaaaatcgtttagttggaatcattacagttgatgatattgttgatatcatgcaggaagaaacaactgaagatatcgaaaaaatggccgcaatggtaccgtcagacaagccttatattaaaaatggcccgtttgaaacatttaaaaaaagaataccgtggcttttgttattaatgatttcagcttctattactggaaaaatcattcaaggatttgagcatgctttagcgggctctgtgattttaacggcttttattccaatgttaatggatactggtggtaattcaggttcgcaagcctctgtctcaattattcgggctttgtcactagatgaaatcaaacatagtgatatcgtcaaaattgtttttaaagaatttagagttgcaattttagttggggttactttagcagcatgtaattttattaaaatgatgattattgatcatgtttcaatcatgatagctgctgtagtttgtctaactttgatagttactgtaatcattgctaaaatcgttggctgcactttaccaattttagctgataaattaggctttgatcccgctgtgatggctagcccgtttatcactacgatcgttgatgctttgtcattgttgatctattttacgattgctactaatttattaaatttataaagtctctggaagattccagagactagtttttatttacaagaatcattattgcgtagatcttgtaatgcttcaatagcacaacaggctttttcttttaatgcgttttctagttcctttacagtaccaattgtctgtgctgctgattcattgattgcaattaattcatcgatacatttagctaaacatactgcttttttaattttttcactttcagcacataaaattgcagctaaggcaccttcttgcattgcaactgattgtaaaacagccgctaaggcacaacgttcatcaacgcaacaaccttcaatacagcaattgtccatgcagcagtcatcgatacaaaaatctcgattacatgaattcatgggtttcatctccttccatactataagatatgcaaggggaatagattgttagtggcttatgtcttgaaaaacaaaaagagcgtgataacaacgctcttatatatttattcaactgttactgatttagctaaattacgaggtttatcaacatcgcaacctttaagtttagcggcataataactgattaactgcagtgggattgcaactaatactgcttgtaaaattggatttacatcgggcatgtaataagtttcatcaacatttccaacctcttcaccggttaatgtaaataaaatgacttttgctcctcgagcaattgtttcttgaatattgctaattgtttttgaagctatatgtggttgtgtagcaactgcaattactacactgccttcttcaatcaaagcaattggaccatgctttaattcaccagcaatataagcatcagcatggatatatgatacttcttttagttttaaagcaccctctaggacggaagcataatctaaacttcgcccaatatagtaggcatctttttgattttttaaatagttcgcatatttttcaaatagtggttcatcttttaaaatattttcgatttgtttaggcaatttagcaattccgttaataatgtctttatagatatcattttcttttcctagggtctgtgcaacatacattgctaataataataagacaataacttgcgtagtataggctttagtacttgctacagcaatttctggtcctgcacaagtataaattgttgcttcagcttcacgcgagatagttgaaccaagaacattagctacggcaatcgtagtacaacctttattttttgctaaacgtaaagcagccatggtatctgcagtttcacccgattgtgagacaaaaatacacagagttttttcatcaatgatagggtcaccatatctaaattctgaagcggcttgggtaaaagtaggaataccagttaagcgttccataatattggctcctgaaaggcaagcatgatatgcagttccgcaagcgacaaaatatactttattaaaagttgtaaaacgttctttcaatatttctagttcaggcaaaataattcgatcattaccttcaactcggcctcttaaagtttcactaatagcatatggctgttcgtgaatttcttttaacatgaaagtatcgtaaccgcctttttgagctgcttcattatcataagggatatgtgtaatttctttttgaatttcgttgccttcagcgtcatagaaagttattttatttttacataatttagcaatttcaaaatcatcaataaaatagacatctttggtgtagtctaataaagcaggaatatcacttgccccaaaacttgcacagtcacttgtccctaatactaatggactgtcttttttagttacataaactacatccggctctaaagtagaaacaatgcataaagcgtaacttccatcaatgtgagtaatgaccttttttaatgctttcagcatatcaccatcatagtaagaatctagtagatggacgacaacttcactatctgtttcgctatggaatttataccccttagctactagttgttcctttaattctcgataattttcaatgattccattatgcactagtgaaatagtgtttttattattggtatggggatgagaattaaggttagatgggactccatgagttgcccagcgagtgtgaccaattccgacacagccaattggagtatcttgatctagtcgatctatgagattttgcaatcttcctttcgttttaatcgtgaaaagtttatctttatctacaagggttacaccagctgaatcatagccacgatactctaatttagaaagtccttgaagtaagaatggtaaagcttcttctttaccggaaaacgcagtaattccacacataaaaattcctccatagttttgattattcaattgttattatgttatcaatggaggataccgaatgaatttgtttaatgattacccattatttttgttcattgtttaggtagtatcatacctctagaccatccgccgaatatttcgataagtctagccctcgtcaactaattacttagtcctggcgctattttgtatttctgtctccttaataacagttgctattatatacaaataaaattaaaaaagcaacccatattataatatgaagtatttgataatagatgcaaagaaataaagcataaataattagttttattatttacattgactcatttcctgataatttttaattattttatgaataaattaaaaaaaattgtaaaaaataaaagtgattttccaagtttaggagtaaatgataataggagggataaattatgagtgtacatgaaaatttaattgaaataagtaaatcattagagaatttagaagaaacaggtatttatgacgttgaaaaatacagctgttcattgaaacatttgacaaatcaactagaatatttttattgtcatttagttaaagaaaatggacgtgatattgacagtacatattatcatctttctaatcgaccacaagttcatcaattagcatatttcaatatcggacgtggtttccctaaagaattaatggatgggcactggtgttatattttaaaggatcttggctataaaatgctgattattccatgtacttctataaaaggaacaagtgctaatccagaatttgaaatggatattgaagtgatgatgtcgggcgtaaagactaaaagtcgtttacagttgagtgagatacgttgcgttgatatgcagcggcttgatttaagaaagacattttgtgatgttttgagcagtcatgatgatattataaagtatgtaaaagagcatttgttaaaataaaaatagcctaacaagtaggctaataaactaaaatgagtagagttatcaaaagtaatatacaacaaaataacagcgcacattgtccaaaaatattaattaaacctgtagcaataatggctccaatgataaaaaagaagataataatcaaatagcgaaaacaatgatgtaacgcatctttatcatgagcgaataaatatgctgatagtttttgaccggcagatctcaaattcccagtacacattgtcgaggcatacggtaaaccattagttgttctaaatgtatttacttgtaaagaacaaactagaccaattgttacgttgcaaacactatagggaatctctttagggatgaatgcaatgatcgtcagaataataatttcaataattaagattaaatgttgccattcaacatattggacattacttaaacgatgcttaatgtattcactaataacaatacctaaaaagaaagctgatattggtaataaataatataaagcacctaaatagttttgctcagcgattttaagtcccataagaaccatgtttccagtttgggcattagcaaaaacattgccttttagaagataggtataaatatctaaaaagcccccaacgatagcaagcaagattcctgttaaaagtgattcatgaatcgttgcttttaaaaaatttttaattttcatcacgttaaaacatgtagcaggaatgctacatgtttattttataagtttagtagacgttttgtatcgcgagcaattactaattcttcattagttgggataacgaatacttttacttttgaattaggagtactaattaaacgatctccttgaccattaacatttgcatcttcatcaagttcgatacctaaagcatcttttaataaatcacaaattccttttcttgcaaagaatgaattttcaccaattcctgcagtaaagcaaattgcatcaacaccacctaatgcaataaaataacgaccaatataagcaataacacgacgatagaaaatatcgattgcaagttgagctctttcattaccttctaaagcagcattttgaacatctctaaaatcacttgacacaccagaaataccaagtagtccagattctttatttaacatcgtaataacttctttcatgtccattccaacttcttcaatcaaataatcgattacagaaggatcgacgtcaccactacgagttcccatcataattcctgcaagtggagtgaatcccattgaagtatttactgatttaccgtctttaacagctgttaaagatccaccagctcctaaatgagccacaataactttggaatgttcaggatttccaagcatttcgattgctcgttgagaaacatagaaatgactagttccgtgagcaccatatttacgtactttatagtctgtataatatttatatggaattggataaatatagcatttaggatctaaagtttggtgaaaagcagtatcaaatacagctacagctccagcttcagggattgcttccttaaatgcataatatccagttaaatgagcgggattatgtaatggtgctaatgattttaattcgtcaattttactaacaacatcttcatcaatgattgctgaagaatcaaagtatgatcccccttgaacgacacgatgcccaacacctttgatttcatttaactcttttacaattcctttttcaattaaagtatctaataaaagttgtactgcaactttatgatctttaattgggttagttgtaacagtcttttttccttgatatttaatcgtaaagattgaatcttctaatccaattctttcgattactccagatgtaattacagattcgtcatccatttcaaataattgaaactttaatgaagaactacctgcatttacagaaataatttttgccattttataaagcctccttaatctatcgtcattatatcatcattttgtaaaatttctagataaaagcattacgtttattaattttaatatagatttttttaatcattggataaaaagaatacaaattattattaataggtagatttttaactttaaagttagataaaatataaaaatattttttataaatgttgtattgtcgaaatattgaacgagtttaggcaatactgcacttgtagaagaaataatttattataaaggagaagattatggaaaacaaagtgtatggttatgcaagagtttcaacaagagaacaaaatgaggatcggcaaatgattgccttggagaattatccaatgtcaaggaaacaaatttatcttgataaattaagcgggaaagattttaatcggccgcaatatcaaaaattattaaggaaaattcgtgctggagatacaatcgttattaaatcaatcgatcggttgggacgtgattatgaagaaatacaaaaccaatggcgtaaaatcactaaagaaaaaaatgtaaatattgttgttttggatatgccattattagatacacggagtactggtgataatttaacgggaacattcgtggcagacttggttctacagattctttcttacgttgctcaaacagagcgtgaaaatattcgtcagcgtcaaagagaagggattgaagcagcacgaatgcgtggtgtgagatttggacgccctcgcaaagaaattcccgaaaattttgaaattttgaagcatcaatggcaacaaaatttaattgcttcacggcaggctgctaaagaattaggcgtttcacaggatacttttttaagatgggctcatggaaaataacattagtacatttatttgtccttaaaaggtagacaatatcgttcaaatgtattaaaataatatatatgtttttatagtgtgaaatttgttattttataatattttattacgaattttgaccgcataatagatgcttgataatctctgatttatcgttctctatatgcaataaaagcatatgaatttcggtatatgcgtttagggagagaaacgcatatattttattttagaaaaggagaaaagcgatgggtctacttgaaaaaatagccgatattatgcagtgtacctatatttctgatttaagaggaagattatcgcttgaccatgaacagttacagtttttaaatgaattaagagctgaaacatacgctttgtctgaatggcaagaagcagtaaggtatattactggtaatttagattcttttaattcggcagcagaaggaaaaaacatcttattggattactatattaaaaaagaagctacagaaatatcaataaaatgatttttttcttgatattataataagataatctataatagtatacgagccaggggtgcaaaattgctgagaagggcataagcctgatcccttatcatctgaactgggtaatgccagcgtagagagagcaaatttaaaattgtttgcttttttgcgttcgcaaagaagcattttttaattttgttaggctctttcataaggaaggggaaaaacaaatatgaaaaacaaaacatttaagattacaaccaaaacaattgcttatatggcgatgtttatggctttacaagtagttttagaattagcttttaaagtcgttccgggacagcctcagggaggaagtattacgctgtcattagtaccgatcctattagcctcatatttattaggtggatattacggtattgttgttggagcctgctgctgtggactgcattttgttttagggttggctacatattgggggccatggtcattatttttagattatttaattccactagctgtaattggtatagcatcattttttaaaaactttgagattaaaggtcatgtagtttatcctggaattattgttgtaatgattcttaagtttatctcacattatttatctggagcatggctgtttggagcatatgctcctgagggaatgaatccatggtggtattcatttggttataatttagcctattgcctaccaactttaattatttgctacatcggatttgccttaatatatccacgattaaataattcgattaaactgtaaaagaaaagtagcttgctacttttcttttcttctgtctttaaaaaggatagtaatttgtgtataatagtactgttataaagagaggtagtaaaagatgtcagattctctggtaggaaaaaaagtattaattcactgttataagcacgatggaagtattcatcgatgctgggccaaaggattcatcttagatgaaaatgatgatcattttattgcaatcaataatcgcaccttagtaactgaatctgatggtcgaatgtggcatacaagagagcctgccatctgttattttcctaaaaataagtggtacaatgtgatttgtatgattcgtaaaacaggagtttattattattgtaatattgcttcaccaactttatatgatggtgaggcattgaaatatattgattatgatttagatttaaaagtattcccagataataactatcgggttttagatgaagaagagtataagcaacatgctaaacagatgaattattcaaaagaattggatagaatattaaaaaaacaattagaactgctaattgatttagcaacgaaacgtgaaggaccgtttagtgaagattttacgaaacattggtatcatgtatatgaagatttgacacaaggataggagaatacaatggaaaaagtaattaaagtaaataaccttgaagaaacgattgctttgggtaatcgtttaggcttgttattacaaccaaatatgctattgactttaagtggcgacttaggagccgggaagacgacctttaccaaaggaattggtcaaggattagggattaccaaggttattaatagtcctacttttaccattttaaaacaatatcaaggtcgcttgaatttgtcacattttgatgcttatcgtttagaaggacaggatgatgatttaggatttgaagaaatttttgatagtgatgatgtttgtgttgttgaatgggctaattttattgaagatattttaccggtagaccgtttaacaattgaaataaaaaaaattgatgaaaatattcgcgaatttgtctttaaaacaaatagtgaaaaatacgctcaagttgtggaggctttaacatgaagacaattgtaatggatacatcaaatgcttatttagttattggcttatacgaagatgatcaatgtattgataagtatcaagcagatggaaatcggcggcaatctgagtacgctttaacacatcttgatgaaatgttgaaaaaacatcattgggaagttttaaatgtggatgaaatgataattacgattggtcctggttcttatactggtcaacgggtcgctttgacgattgccaaaactttggcagcaatttcaaaaataaaaatcaaggcagtttcttcgttacatggttatgctggagcttctaaggcaatcagtgtaattgatgctcgaagcaaaaagatttttgttggggtatatgagcataatcaggccataattgatgatcaaatcatgttgattgatgattttgctaattttaaagaacaatatcctgattttcaagtgattggtgatagtgatttagtcggaattaacaaagttaaactcgatttaagtgattgtatttatcaagctggtaaaagtgttgattattgtcaaaatattgataatcttgttcctcattatttaaaagatgttgaggcgaaaaaaatatgttaatcagacggatggatttaggtgatattgaagaagttgtaaagttagagcatgatttatttagttcgccatggaatgaagaagcttttaaatatgaattagaaaaaaatgctttttcatcaattttgattttggaagataataatataattgttggttatataggaatgtggacactaggagaccaaactcaaataacaactatcggtgttagaaaagagttccaaggaaaaggctatgctaaaatattaatgactaaatgtgatgaaattacaaagcatttaggctattcgaatattaatttagaagtccgagtttctaatactaaagcaattagtttatatcaaaaatgtggctttaaaattgccgcaacaagaaaaaattactatcaggataatcatgaagatgcgtatttgatggtaaaagaaatggaggaataacggtgtcacttattttagcaattgaatcaagttgtgatgagatggctatggcaatcttaaaagatgaacgagaatttcttagtagtgtcgtggcctcacagattgatgttcatgcgatgtatggtggagtagtgccagaaattgcaagtaggaaacatgttgaatgtgtttcgctagtattaaaagaaactttgaataaggctaacgttacgattgatgaaattgatgctattgcggtaactaaaggaccggggttagttgggtctttgcatatcggtttacaggccgctaaaacgattgcaatggcttatcataagccattgattggagtacatcatattgctggacatatttatgccaataactatgttcaaaatattatctatccaagtctttgtttagttgttagtggtggtcatagtgaacttgtcttattaaaagctccttttaaatttgaagtaattgggcaaacccttgatgatgctgttggagaagcatatgataaagtgggacgagttttaaatttaccatatcccgggggacctataatcgataaaatggctgctaaaggtaatcatacttataatttaccagtgcctttggatgatgaaagctataattttagttttagtggattaaaatctgctgtaattaatttaaatcataaagcgatgcagcgaaatgaagaaatcaatcaagaagatttagctgcctcttttcaagatgtggttttatcggttttagtcaataaaacaatacgtgctactaaagaatatggtattaaacaagtattaatggcaggaggcgtgagtgctaatcgtggattgcgaaatgcgatgggtgaagcggttggccaattagatggagtagaattattattaccgccaatgagttgttgtactgataacgcaatgatgattgctttagcagcaaaacagatgtacgatttgaaattatttagtgatttgtcattagggattaagccaaatttagatttagaaaatgaatcggttagcgggggaaatcaaaatggataaaaaaatatcaaacgctacaatgtctcgttatcctgtttatcttaaagctttaagaaaaatgcagcatgaaggtaaagaaaattgtttatcaagcgaattatctagtttaacaggtattcaagatacgacgattcgtagagattttacttatttatcaaagacagataattttggccaacgtggtaaaggttatgatgtaaaacatttaattgacggattaagtgaggtattaggattaggactagacgaatcaattattttgattggtatcggaaatcttggtagtgcaattttaaaatataaccgttggcaatatacagtgggaaaaattgtctgcggctatgatcaagataaaaataaagagggagagcgttttggtgttaaactctataatattgatgatttagaaaaaacttttcctaaagactgtaaaattgcaatcttggctatttctgaaaacgttcaaccaacagttgatcgtttaatggatttaggaattaaaggtatcgttgattttacacatacacattttacagttcgtgaaggagtcgaggtacaacaggtagatgttgttgtagcaattcaagaattagttattaagatggattcaaatcgtcaataatacttgaataatggataaaataaagtatataataggaaaaactaggaggattaatatgtttgaatttataacggttagagaactatatgaaatgtttttaagtaaccaaatgatggatttagaaggttacgaatatgttgaacttgagggatgggttcgaactaatcgtaacaatgggaaattgggatttattgctctaaatgatggtacatacttcaaaaatttacaagttgtatatacagaagcagaaatttctaactatgaagaaatcgataaattatctactggtagttcaattcgagtagttggaaaattaaagttgacacctgaaggaaaacaaccatttgaagttgaagcaactgagattgaaatcgaaggtaaatgtgatgaagattttccattacaaaagaaacgtcattcattcgaatatatgcgtgaaataccgcatttaagacctcgtgcgaacactttctatgcaatttttagattgcgcagtgttttatcaatggctattcatgaatttttccaatcacaagggtttgtttatgttcatacaccaattatcactggaaacgatggtgaaggggccggagaaatgtttagagcaacaactattgatggaactaattttgaagatgatttctttgaaaaagaggctttcttaacagttactggtcaattacatgttgaagcttttgcaatggcttttagagatgtttatacatttggtcctgcatttagagcagaaaactctaatacttctcgccatgctagtgaattttggatgattgaacctgaaattgcttttgctgatttagaggatgatatggatttaattgaagatatggttaaatattgtatcgattacgttttagataatgctcctgcggaaatggaattctttgcttcaatgattgataaagattgcatcaatcgaattactaaagttaaaaacagtgatttcaaacggatgacatacactgaagcaattgaaattttagaaaaagcagatgttaaatttaaaaataaagtttcatggggaatggatttaaatagtgaacatgagcgctatatttgtgaacaggttgttaaaggaccagttttcttgacagactatccaaaagaaatcaaggctttctatatgcgtttaaatgatgataataaaacagtggctgcttgtgatttattggttccaggaattggagaattagttggaggaagtcaacgtgaagaaagatatgatgttcttgaaagaatcatggatgaaaaaggaatgtctaaagatggtttacaatggtatatggacttacgtcgctatggtggctgtaaacatgcgggattcggtttaggatttgatcgtttcttaatgtatttaactggaatgcaaaatattcgtgatgttgaacctttcccaagaacaccaagaaatttaaaattttaacaaaaaggcctatattttatataggcttttgctttgaatgggttataataatagataaggaggcgatcaaataatgaatgagtatgatttaataaatgcttatctaaatttaatttttgatgatagcataacttattttagtcgcattcttgacgaatatcgtggtttatgccagttgagaaaatggatgcgtaaacgtggtattaatttaaaagccattgaaaatattggttatgatatgtttttagcttttagtaaagctaaaaatgctgaacaaatcatggaaaaaatggatccgactcatttagaagaattaaaagagtatattaatacagaacgtaataaatatcagatcgtagtattatcaagttttgattatagtgagccaattaatgcgtatttaacctcaaatcagattgtggatgatttagacagtgataatattagggttttaaattgtcataatctattaaaaaaagaagatttatcattttatggaccttttaaacattttgttacggccttatatcaaattgatcgctggcctggatttttaatttttaaaggtgatgagtgtgcatttgttcctatttatactactcaggacattgaagaagtcatttttaaaattgaacatgatacaattttttcaattcgatatttaagtccttatgatagcttttttgtgcagctaagtgatttacaccttggtagcaaaaagaagaatatcggtcgtttggcacttgaagatagtcttgatcaaactgttaaacagctacgttcttattatcctttaaagtttttgattacgggggatttaatgaattcaccaaatcgaaaaaatatgtatgaggcatcagggtttatgaaagggttaaaaaatcgttataatgcagatgtttcctttattttaggaaatcatgatgtaattgttaatggttttaatatttttaagcgtcagaaaagtaaagtaatcgcctttttgttaaatgaaagcattaaagtatttgaagaagaaaagattgttttaattaagattgattcaactgtagaaggtaatttagcgcgtggtaaagttggaatgaaacaattaaacaatattgatgaagagcttgccgctattaaaaatttaggagattatacaattgttgcaatgctgcatcatcatctgtttccaattacccgtgatgattttttaaagcaaaaatggcgtgaaaagatttttgttgggaaaattatggatagttctaaggcattagtagacagccgtgatttagtagaatggttaagaaaacaccaaattcagtatgttttgcatggtcataaacatttaccattttttagcagtcaagaagggatgtatgtgattgctgctggttcttcatgtggcagtggagcaaaagaatcaaagagtcgatatttaagttataatgtattaaaatatgaccatcgttataaacgatttaaatactgttttatcatttatgatgatatgacgatgcaagaccgtcaaagaatagttataaatattttttaggagagaaaaatgaagttagtagatggaatgaaagatgaaaaattagggagtgctttattgtattgctttactaaaggttatggagctgtaccgatggatctttataatcttgttttaccattattatttgatgatatttttagagaagaggtaaagataagcaaagattttagtagttgtattagggcttgtattcaaaaaaattctgaatttgttaatcaaattctaaatagtgttgaagaattagaagaggtaacgagtcgcagtttaggaatttctttattaaataaagatcttgattttcaaatcaatgatggtgtaatgagcggaaattgtcgaccatcaaaaattcttgatttaaatgaagctattattttaggaaaaatgatacaaggaaaaggttttgatgaagtagttacaatgatgaaaagtgattttaagattgtctttttggatagtgagacactgggtagtgatattgatgtcagcaaattaaatcgatatggtgatgtaacaatatatcatcaaagtcaagttagtgaggttcctgagcggattaaagatgcgagtgttgtaattactaataagcatatattgaaagaggaacagttaaaagatgctcataaattaaaacttatttgtgttactgcgacaggtgttaataatattgatcttgaatattgtaaggctgccggtataaccgtatgcaatgttaaaggctattcaacaaatgcagtagcacaacatacattcgctttattattagatttatacaataaaaatcattattaccataattatgttgagagcggtaattatgcatcaagctctatgtttacccatttaggatacactttccacgaattgactggtaaaacttggggaatcgttggaatgggcgatattggccgtaaagttgctgaaattgcaaccgcatttggctgtcaggttcaatattattctacaagtggaaaaaataaccagcaaaattatcaacaggttgattttgatacattactggaatcaagtgacattattagtattcatgcacctttaaatagtcaaacagaaaatctttttgaccaatcagttttcgcaaaaatgaaggattcagcatatttaattaatgttggaagaggaaaaattgtaaatgaagcagatttagttgaggcattaaaagaacatcgcttagcaggagctggcttagatgtttttgaaaatgaaccattctgttgcaacagtcccttattagaaatcaaagatgcaacaaaattaataatgacaccacatattgcctgggcaccaattgaaactcgtaatcgtgtgattgaagaggtttgtttaaatattgaaggatttaaaacaaataatttacgaaacgtttgtaatatgttataatttagttctagtcgtggtgaaagattcgcttcttttatcatatattggagatagctttgctatttccatttttttgatttattgattttaaaacctttttataggatttaaactgcataataaaaatgcataaagtcttttctttgtttataatataagtgtaaataaaggaggaactaaaaatgaaatatgctgtagtagatggaaaattaacacatgtaaataaggttcctaaaggaacaattgcaagagaatttggttattctaattatcctgtaattgcctgcaaaggaaaatatcgctcatattggaaatatgtaagtgttaataaagcaaactatgcctaattcaaactctcatctttcgatgagagtttgttttgatttaaaaacaatttattgcatttcatgtttaactaagctagaattattaagaaatattaatagaagggtttaatttcatgaaagaaagagaaaaattttcatcaagattaggttttatcttgatatcagcagggtgcgcgattggacttggaaatgtatggcgttttccatatgttgttggtcaatatggtggggcactatttgtattaatttatttattttttttaattgctttaggagcaccaattatgacaatggaatttgcagtcggacgtgcaagccaaaaaagtgcggcattagcatttcattcgctggtacctaagagaaaattttggggtgcaattggaaaatttcaaatggctggaaattatatgttgatgatgttttatacaaccgtcggaggctggatgattgcttatttttttaaaatgataaaaggtgactttaacggtattactccagcacaagttggagatatatttaataattcgctccaagatccatttatgcaagtattctggatgattgtagtggttgttttgggatttggaatttgttccttgggccttcaaaatggtgtagaaaagattactaagatcatgatgagttcattattaattattattttgattttggtgatacgtgctgttactttacctggtggtagagacggtttggcgttttacttaattcctaatttagcggcaattaaacaatatggtcttttagagattatttttgctgcaatgggacaagcatttttcactttaagtttaggaattggggcaattgctatttttggaagctatattggcaaagaacggcgtttatttggtgagacaataagtgtatgtactttagatacgttagtggcattattatcaggcttaattatttttcccgcatgttttgcttttggagtaaatcctgaaagtggaccgggtctggtatttattacgttgcctagcatttttaatgaaatgtggttaggacaagtatggggatgcttattttttgtctttatgagtttcgcagctttatcaactataattgcagtatttgaaaatattatttcatttgggatggatttatttaattggagtcgtaaaaaagcagttgtagttaattttattattattttaattttatctttaccttgtgcccttggctttaatattcttagtgatattactccatttggtatcggaacaacaattcaagatcttgaagatttcttggttacatataatttcctgccacttggttcattagcgtatttgttattttgcacatgtcgttatggctggggatttgatggttttctccaagaagctaatacaggaacaggaattaaattcccaaaatggacaaaaaattatttaaaatttattcttccttgtgtgattatttttatatttattcaaggatattatacgtttttcattaaataattgtttgataaaaggtgttgctttaagtaacaccttttatgcaagttatttgttgaattttgataatatttgattgttctaaccgataaagagtaaatatgcaatagttgcaagaaggcaagcaatcgcatcaagccaaagacctaattttaaggcgtatcgattattttgaagttttatactgccaaaatacaaggttacaacataaaatgtagtatcgctgcctgtctgaataatggagccaagaatgctataaggatgatcaaccccatactttaaaaagatattatttaaaatagttagtgatccatttgaagaaaatggtctaacaatcatcatcataaagatatcaataggaatattcaaaatagcaaaaatactcttaaaaccgatttctagtagttcaattaggccgcaatactgaaaacatgtgacccatagtgtaaaagccatcattgttggaaataaagtaattaggagtttactgccttcctttaccccttcgataaattcattaaaaatatcaacgtgtttaaaacttgcttcgactagagctattaaaatgataattaagattacactatccataatgttcaatcaccttacttgcaataataccgacgattgtaatgacgaaaccaatagtaagactatagccaaagaagccaaggatgtcgtggctgccataactttgtcttaacgtcatcattgttgtaggaatgattgaaaggccagtagtgtttaaaataactaaaagcatcatttctttgcatggagtctttggatcacgttggtattttgtcagagattgcattgcttttaaaccactaatagaagccaaagaaccaactcctaataaattagcaataaaattagttgagagatatagataaacttgatcatcttcgaccgtattaccatagataagttttaaaatcggcttaagtaaaaacgataattgtttaataagtcccgaagctttaataatatttaaaaatccattccaaagacaagcacttaaaacgattactttgattaagtcaaaaacttgttgtggtgaacttaaaattgcttcaaacattttattttgattattagtgcaaaaagcaattatcacaaagaaaattaaaccaaatttaaaaactttagccatagaataaatccttcaggaccattttgaaacctaaaaagtaattgtatggaacaactttttgtttagcaattggctggttatttaataaaattacaatttcattattatttaatgaaacttcaactttatcagttggttttttattaacatagacatcaaagtctaaatagtactgttgttgtttaaattcaacgataccttttgagaatattttagttgcttttaaattagcataacattcttcaaatttcttttgatgaaattcaaaatcatttccacaattaaaagtaacaataattaaatcaagatcatctttacgagccatggtaattagggttcgtcgtgcttttttggtaaaaccagtttttccaccaatacaatattcatagttggttaataatttatttttgttatgccaagtcccattaccgtcttcgcgtttgtattctttagtactgacaatttcattaaaaattggattttgatggcaataggccattaatcgtgccatatcataaacagtggattgattcccgttatcttcttcatctaaacctgttggattagaaaaagttgtgctatgcaactgaagttcttttgctttgtcattcatcatatcaacaaattttggaatttctttaccaactgctttagcaatcattacagcagcatcgttgccacttctaagcatcaaaccatatagtaagtcacgtagactgattttatcacctatatgtatatagacaccacttccccaggctttatttattgtatcatcaactgtaatgatagtatcaagttccatgttttcaatcgcaataatacaggtcataatttttgaaattgaagcaacgctctgaatgtaatcttgattactgccttcgattacgatttgatgactagcttccatgacaatataactttttccttggaagggtacagcactgacgtttgtatttactagtgtcatcattaaacttataattaatcctaatttcattttcttcacccctttaaacatatgttgaacttggaaaaatagaagttttagagtagaaaataaaactgtcaaaatatcctaatatttgtaattataatattaattgtattaaatccaggtaagatatataactataagcattgaatttgtttcaataacccaaaatttaatattagtctttgtggcatgaggagaatccctaccgatggttacagttcatgacccatattttataatatggctgagttagtaaaattctaatatcgacggttaaagttcagatgagaaaagacattttctagaattctatcgaaggcattttattatgttttcggttttttattttaggaggaagaaagttgaaaagaggaaagacaaggtaattagtgttgaacgcaattttaggggcattataggcgatgctgatggtattttgattcccattacctttaataccaccatttttatattttgatacagcttatgtttacaggtgaattacaaagttttatggttaagtattgctttggtttaaccagcagccttgatctatcgttatgataaaactaaaattgttacttttaaaggaacgtgggttgaaattattattaatgtaggagttgttctctttaatttaattaaaagtattattgtatatttgattacattattggtatataaaaaactaagtactataattcatcatcatacaggtgactaaaagaaaagagaggtgatttttgaagatggagctgttttattttttaaaaaattaggaaattggaaaattatgtattagcgactagtgtagatgattatgtaacggttcgtaatattagttgtttattttaaaacagataaaaattttagaaaaactcaacaattatttaaaaatcctcaagttgcattatgcaatggaagaattcaaatagaagggctgacgaaaaatataggcttagtgattgaaaaactgggacgtaaatttgagcagttatatcgtcagtatttatgacaaaattacaatgcgtatagttatgaaaaacagagattttaattgaggctacacctaagttcgttgaaatttgggatgaaaatgaaaatcattttacttttcaaacttttattgattttgaataaaaacagttacaataaaaaatgtgattaaaggctaaaaaaacaaataatcccttgtcgttcgacaagggattatatcattaaattttagactttatttatattcttcaattagtcgttccaaataatctttatatttagaatcattggcattaagtttatcagaactattggtatatttttttactgcggttgtagctctagtgattggtaataaagttccagctccagcaacacaaccaccgggacaagccataccttcaagtagataaccgtcatatttaccactttttgctaatttaagcatttttttacaatttgctaatccttctgctgattccactaatacttcacgttcaggctctttagctttaatacaatttacgactgctttagcaaccccaccgctaacggcaaaaccgcgaccatcactactagcctgagtaaatggatcagcttcatctggttttaaagaagcaaaatcaatgcctttagcttcaaacattgcgccaatttcttcaaatgttaaaacaaaatcaacctcacttcgtactgattttctagaagcttctagtttttttgctgcacatggccctacaaaaacaactcggctattaggatgtttttcttttatcaaacgagcggttaataccattggtgttaaagccattgatatataagatttaaattccgggaattcttttttggccatcattgaccaagaaggacaacatgatgttgccataaacggttgctgagcaggtactttttctaaaaagtcctttgcttcatcaattgtacataaatcagccccaatggcaacctcaaccacatccttaaaacctaattgctgcattgctttttttaaaacttctggtgtgactttaggaccaaattgtccaataaatgcaggagctactgctgcaataatttcatcgccggccttaattgcttgaattaattggaaaatttgacttttatcagcaatggccccaaagggacagctaactaagcacattccacaagagacgcatttatcataattaatgtgggcattaccatattcatcagtttcaatagcatccattccacaagccttagcacatggtctttctctttttaaaattgcatcatatggacaattagttttacaaagaccacatttaatacatttatcttgatcaatatatgctttcccgtctttaaagctgattgcatttttaggacaaacttcgatacatgggtgcgctaaacaggcctggcagccactactgacctcaaatttcttttctggacatttattacaggcaaatttaataatgttgattaatggtggttcgtaatatttgtcggcaataatactttcttcaatccctttagatattggtgctggttcatcaatagggcgcaatgataatcccatcgttaaacgaattctttcaccgacaatagcccgttccaaaaaaatactgtcacgataagttgcgacttctccaggaattactttatagggtaaattttcgatacgactataatcattcccctcataggctaactttgcaacttcaacaaaaactttacgtcgaattttagttaatgatgaataaattcctctcatagtgtttcctccatattatttataactatattttactccaaagtgcaagtttataaaagtgaactgtaggatatttatataaaaataagttattcgtaagataattggttgcttttaattgacaattcagtataatgattacgaagtaggtgaaaagacatggaaagattacaaaaagcaattgcggcaagtggttatacttcgcgaagaaaagcggaagacttgatcgttcaaggaaaagttgaagtaaatggcaaagtcgttactgaattaggaaccaaagtaaaacagggagatttaattacagttgaaggaaagccgttggttggtgaaaataaagtatattatgttttttataaacctaaagggtgtgtttgtactttagatgatgaatttgaccgacctattattacagattattttactgaagttaaagaaagaatttatccagttggaagactagattttgatacaacgggattaattattatgtctaatgatggagaatttgctaatatgattatgcatcctcgttcacatttagaaaaaatttatgaagtatctattaaaggtttaattactggaccaactttaaataaactggaaaagggtgtttatttagaaggggttaaaactttaccatgtaagattaaagtcgttgacaaagataccgaacataaaaccacaatgctgaaaataaagttagtagaaggtaaaaaccgacaagttaagaaaatgtttgagagtgtaggacatccggttaaaagattgcatcgtgtaagtattggtggaattaatttaaaagggctaacaccaggaagatatcgtattttaaaaccgcaagaagtaaaagatctaaaaaaattagttaatacggataagtagatcacttatccgtatttattttgacaattattttaatttgtttggtgcatactgtattttgggtgatgaaaatgagaatacaaatagttgaaccacaaaataaaattgaatgtggaatatgcaaagccgagggtgattggatcaaacgaataaatgtacgggggattcaagctttatattgtatcaagtgtgacacagtgacaatgtttaataagatgccatcaaagtttgtttataaggcattaaaaaaagaaaccgaaaatattcggatggcttataatttaaaacaagacgaaaaagttaaataaacaaattagttgactttaatcaataaatgagtagaattagtatagtaaatagatgcgatgatttaggatatgtctagataatactttgattcagagaaaagacgggtggtgcaagtcttgataaggttatttaggtactccctaatatgcaacactcgaaagagaatgtcggtagtgcgttatagctttgaggttatttcgataacaaattaaggtggtaccacgatactctcgtcctttggatgagagtttttttattaaaaaacagtaaaggagaaaaataatgattgattttaaagaagacgaaaaactaagtgtattaaatcactcttgtgctcatgtaatggcacaagcaattaaacatctttatcctcaagctaaattttgggttggtccagttgttagtgaaggattctattatgatgttgatttaggaaatgatgtaatcaaagatgaggatattcctaaaatcgaaaaagaaatgaaaaagatttgtaaagatggcaaacgtattactcgccaagaaatttctaaagaagaagccttagaaatgttcaaagatgatgaatataaaatagatttgatcaataattttgaaaatgatacaactattagttgttatcgtcaaggagattttgttgatttatgtagaggtccgcatgttgaaacagttaaagcttgtaagaactttaaattgactaaacattcaggtgcgtattggaagggtgacaaagaaaataaggtactacaaagaatttatggtgtttgttttgaaacttctgaagacttagctaaacatcttgaattattggaagaggcaaaacggcgggatcataagaagctaggtaaagaactaggattatttatgatgagtgaatacgctcctgggatgccatttttcttaccgaaaggaatgattttaagaaatactttagaacaattctggtacgaagaacatgctaaagaaggatatgaattcattaaaacaccaattatgatgtcacgtgaattatgggaaactagtggtcattgggaaaattataaagaagatatgtatactagtatggttgatgaccgtgaatttgcaattaagcctatgaactgtccaggaagtttgttagtatataaaaattccttacattcatacaaagatttaccattaagaatgggtgaactaggtcaagttcatcgccatgaagctagtggagccttgaatggtttatttagagtacgtacttttactcaagatgatgcacatatctatatgacacctgatcaaattgaaggtgaaattataaggttgattaatttcattgatcgtgtttatggaagcttaaatttaagttatgaaattgaattatctacccgtcccgagaagaaatatattggtgatttagcaatctgggaaaaaagtgaagctgctttagctgccgcttgtaaagcagcaggtaaggattataaagtaaatcctggagatggtgctttctatggaccaaaactcgatttccatgttaaagattcattagggagagtttggcaatgcggaacaattcaattagacatgaatttaccagagagattcgatattacttatattgatgataaaggtgaaaaagttcgtccagttatgctgcatcgtgttatctttggatcgattgaaagatttattggaattttaattgagcattttgctggtgtgttcccattatggttggcacctgttcaagttaaagtattgccggttaataatgagtatcatttagactatgctaaagaagtaactgagttattaaaggataaaggctttaaagttgaactagatgctcgtgaagaaaaattgggttatcgaattcgtgagggacaaatggaaaaggtaccttatttattagtattaggtaataatgaacgtgatgaaaaaactgttacatatcgtaaacatggagagcaaaaacaaattactgttccatttgatgattttgtcgcaatgctaaatcagcagattgttgataaaaaatagtaaacacttagcaaattaaatttgctaagtgttctttttggtttgataaacttctattttatagatgcgtaattaaaattattagaataaatttacattatttatatttcgaagaaagatatagatgtgatataattaaaatattgaaaagagggataaaaagatgaaatattatttagcaatggatgttggtggaacgtcaataaaatatggtgttgtcaatgatcagggaaaaatcattaatactgataaaatcgtaacgcccgattcactagaaaaaatgtatcaggcaatgggtgagatttatcataattgtaattatgaagtaacgggaattgcattaagcatgccaggtgccgttaacagtgaagttgggaatattgaaggagcaagtgctttagattatatccatgggccgaatatcaaagaggatctacaaaaacgcttcaacacaaaagtttcaattgaaaacgacgctaactgtgcagcattagcagaagtttggaaaggatctggaagtgatgtggatgactgtatgttcattgttagtggcactgggataggtggtgctgttgttaaggatcgaatgattcataaaggaaaacatcttcatggcggtgaatttggctatatggtggccttaaatgatcttgataatgattcctatatttcttggtctactgcaggatctacagttgcaacagtaaaaggggttgctaaagaattgggagttgattatcaaactttagatggtaaagtgatttttgatcaagcacaagataaccctatttatcaaaaatatgttgatcggtactatagtgtcttagcaatggggatatataatcttcaatatgtctatgatcctgaaaaaattattattggtggagcaattagtgtacgacctgatttaattgaacagattgaaagtcgtttagaaaaaatatatgatagtattcctgttgcaaaaattcatcctaaagtagttaaatgtcgttttggaaatgaagcaaatttaattggagcagtttatcactttattcatagctagtcattaagaattcatattattgtattaaaatattattaaataaaacaaggggaggtaaaaaaatgaaaagagaagcaccaaaaatcaacacacagctaagaagccatacaattatggtaccagagtgtatccgcaatgccagtggaatagttattaatggcaaaagaattaaatcattattattctcaacagatgttgcagtaatatccaattgtaatgctgatgctgtaatcgcggtttatccatttaccccaaccatgcaaattactaattcaattatcgatgtagcacaacgtcctgtttttgcgggcgttggcggtggaacaacagcaggacctcgagtacgggagattgctttggatgcagaattacatggtgcaactgcagttgttttaaatgcacctacaaaaactgaatttattcaagaattatctgattatgttgatattccagtagtattatcaatcgtttctttagatgaaaatcttgaggaacgcatgttacattctggagcgacaattgttaatgtttcgggtggtaagaatactgttgcaatcgtcaaagcattaagagagatttctcaagattttccaatcattgctaccggtggacctaatcttgaaacaattcaggcagttattgaagcaggtgcaaatgccattacatatacaccgccttcaaatggtgaaatttttaaagcgatgatggaggactatcgacagcgttgccaacatcaatgatttgttttgggtagattgatatctaccttttttgttgttcaaactggtattttattgtacaatagttgctgaggtgtaaaaaatgaaacaatatctagatatgtgtaaatatgtattagaaaacggagaaaatcgcgaggatcgaacaggaacaggaacacgtagtgtttttggatatcaaactcgttatgatttgagagatggtttcccgttgatgacaactaaaaaaatgtttttgcggccaattgctgaagaattattgtggtttattaagggtgatacaaatatcaagtatttagttgatcgcaatgtcaaaatatggaatgaatggccatatgaagattttaagaaatcacctgattttaatggtgaaacaattgaagagtttgtagaaaaaattaagacagatgatgaatttgcaaaaaaacatggtgatttagggccggtatatggcgctcaatggcgtgattttaattatgaaggggttgatcagttagcaaaattagttgatagtctgactaacaatcctttttcaagaagacatattatatgtgcatggaatccagcacaagtagataatatggcgctgccgccatgtcatgcatttttacagttttatgttagtgcagataaaaaatatctgtcttgtcaactatatcaacgtagtgcggatatttttttaggggtaccgtttaatattgcttcgtatgctttaatgacggaaatgttagcgagaacttgtggatatgaagcaaaagaatttatccatacgattggtgatgctcatatttataaagatcattttgaagtagttaaacaacaaattgcaagagaaccattaccaaaatgtaaattagtattaaatccagatgtgaaatcaatttttgattataagattgaagatattaagatagaagattaccaaagtcatggtaaattagttggaaaggtaagtgtataatgataaatataattgttgcaacagatgaggatctgttaattggaaagaaggattcacgaaatggaatgccttggaatgttccggaagatttacaacattttaaggcaacgactttaaataaaacaattttgatgggattgactacatatcaggcaatcggacgtcctttgcctaatcgtaaaactattgttgttagttttgaaccgtttgaagatgaacgagtagaagtgagaagctcattagaagaagtaatagaagaataccgtagtagtggtgaagatttatttatttcgggtggagcttcaatttataaacagtgtttaccaattgcagaccagttgttaatctcaaggattcctggaaaacatgaaggtgaaacatattttcctaattttgatgaatacggttacaaattggttgctcaaaaaccatttgagacatttacattagaaacatataagcgaggataattaaatgaagagaattgcattgattgttattcgtgttatttggcggttaccatattggtggggatataaagtcaataagtataaacatattgataaatattctgctgatgaacgctatgggtttatacatcaagttgtagcaattgtaacacgcaaagcaagggtagagctagagtgttatggggtagaaaatttacccaagaaatctggttattttgttgcccctaatcatcaaggattgtttgacccgctagcaatttttcaaacccatagtcgtccaattcgagcaatcgtaaaaaaagaattggtatcagtcattttagtaaaggatgttattaagatgctggaatttatttcgatggatcgcagtaatgttcgagaaagtgcaaaaatcattaaatatgttgctaatgaagtagcggcgggaaaaaacttttttgtttttccagaagggacaagaagtagagacggcaataatattttagaatttaaagggggaacttttaaaattgcgactaaagcaaaagcaccaattgtgccggtagctttgattgattgttataaagtatttgataataatacgataaaaaaaacaacagctcaaattcattatttaaaaccaatttattatgaagaatataaagatcttcatactaacgatattgccaaattagttcatgatcggattgaaaaatgtattaaagaaaatgacaaaggatagaaatatcctttgttttatgttataatctatttagaaaatattctaaatagattggagtgatgattgtggggtttgcagaaacatttaaggcactttcagatccggttcgtcgtgaaatattggtgttacttaaagatggtaaactctcagcaggagaaattgcaggatgttttgaaatgactcaagcaacagtatcttatcatttatcaaaattaaaacaagcagatttgatttttgaaaataaatacaaaaattatatttattatgaaattaatacttctgtttttgaagaagtaatgttatggcttagccaatttggaggatttaaagatgaaacttaaaacggcattaattacatgcggagtatgtttgctgccgattctatttggactaattatttatgattgcttaccagcacaaatgccaattcattggaatatagcaggtgaaatagataattatgctagtaaagagatttttgtttttctattaccgatattgatgagtggaattcaactattgtgcttgtttatgatgcaaatggatcctaaatacaagaattattcatctaagatgttaaaaattgttgtttggataattccaacgataacaattgttttagaagcaataacatatgcaatcgtatttggatatgaaatctcaattaatatagttgttccaatatttttaggaatattatttgttattttagggaattatttacctaaatgtcgtcaaaattttactatgggctaccgattaccatggactttgaatgacgaggataattggaataaaacaaatcgtttagctgggtatgtaatggtccttgggggtattttaattattattatgagtttctttgatctggctttttgggcagtaattttgtttgttggagcgattttaataatcccttcagtgtattcatttttactctatcgaaaaaaataataaaatagatgattcgatacatttttatttaaagaattaaatagaaatgtatctttttagatgctttgtttttttatttgaagtacaataagagtaggagatgataatatgggaaaattggaggatttaccaaatattggtaaggtagtagcacaacagctgatacaagtaggaattgatgatccgataaaactgaaagaagttggagcaaaagaggcatggttaaaaatacagcaaatcgatgaatctgcatgtattcatcgcttatatgcactagagggggcagttgagggaattaaaaaaacgcaattagattatgaaacgaaagcagaattaaagcaattttataatgagcataagttatgaaaatattagttaatggtattgagttattttatgaaatatcgggtcagggacggccgcttattttagttcatggtaacggtgaggatcatcatatttttgatgcattagtggccaaattgaaaaatcactatacttgttattgtgttgacagtcgtgggcatggtttaagttctagtgtagctgtatatagttatcaatcaatggctgaggacataattgagtttattaaaagcttaaaattatcggaggttgcctattatggttttagtgatgggggaatcgtcggattattagtagcgagccaaagtaaactgataaaatatttaatgattagcggtgctaatgctgaccctgatggcttaaaaaattgggcttattatttgatgaaaatacagtattatttaaaaaaagatgtaaagattaaaatgatgctggaacaaccacatattaatgaatatcaattggctaagataactgcaaagacgctaattttggtaggaagtgatgatatgatcaaagaatctcatacgttatatctcgctcacaatataagtggaagtcaactaatgatcttgcctaatgaaaatcatagtagttatattattaatagtgcaaaacttgcgccaattattttggcatttttaaaagtcgcttaatgaggtgaatacaattttttggacgctaagttagttatattattaataaggattgattcttgttaagtagacaaatgaaataaataaaaagtgtgagatgttttactgatttggtgaaatgtcttttttatatcagtatataattattgtgtaaaattcttaaattatcgaaatactcttgaatatgtatatcttcttttataggatactgagttggttccttgactgtatctaaagctataaagcgtacttctggtggtgttatatttttgaatcgttcttgtaacttttgttattgtagaaatttatataggaattaatggattcttttaatccttcataaacatgaaatttctttaaatcatgcacattgtgctttcctagcttatacccttttgataatgaaataagtaatattccttgtatttgtttaatatagataccaattttttgctctgttgttggctttgctataataaaaaccccaaaagttggttatatccagctttcggggtttgcttcacaatgtgacttttttaaataggtatttaattcttcaatatttggtaagccttcgttatctccaagtgtttgaacttgaatcgcgccaattgcattcgcacgaatcaacatatctttactacataatgcttccaaatgacctgaaataattcctgctgcaaagccatctccagcaccaactgtatcaatcactttttttacattaaatccaggaactgttaaagtttcatttttactgctgtaataagcaccttgggaaccaagctttattacgagttcatcacagcctagctggtgataatatacagcgattttttcaggatcatcactgcccatgagaatttttccttcgttattgcctggtaagaacatattacaatatttggccatttcattagtggtatcgatcattgttgtttgattaggccaaagagatggtcttaagttcggatcaaatgaaatataaagaccggcttcacgagctttttttacaagccttaaactagtttctcgagttttagaagacagtgctagggggatacctgtaatatgtaattggtcaaagtcatttaaattgatttgatcaattagattagtgtcaatattcgaaaaagcagaaccttgacgataatagtaaatatcaggatcaccctcaataacttgatttttcatcatcattccagttggaaaaagactattatagtaaactaatcttgtatcaattccttcttgataaagcttttttttaatgtaatgaccccatggatcatcacctaaaacagttaaatacgtagcttgatgccctagtcttgttaatccgatagcaacattaacctcggctccagctagtgtctttttaaacatctcggcttcatctaatgaatcatacgatgttgttgtaagcagagccattggctctccaaatagtaatatttttttcattttatccctccagacataaatgacatttacaaccgcttattagttcattaaaatagataaattcgattttatttttatggttgtaacgagcagtttgcatatcaaaagtataaccttgtttttctagaaagaatattgcccgttcaatactcttggttgacaaacataggtggtggagggaaccactaggcgtatcaaacataaattctatttcatctaccattcttgaaatagaaagatttttttgatgaggactattgattagagccgctaattgagcacctcgatcaccagctccgattccaacatgatgaaatttaatatctagcatggttttaactgcttgtttagtaatagcagtaatttcatcccatttatgttctttaattaattcatcgctgaccatccaagtcccgccacaagcaataattttatcaaatgctaaatattcagttaaattactagtgtttattccgccggttggcatgaattttaagttgcaatatggcgctgacattgccttgattgcgggaagcccaccatttgcttgagctggaaagaattttactacatctaggcctaattcaatcgcctgctccatatcacttgggttggcacaaccaggtaaaataggaatatctttatcaagacaatattgaacggtcttgggattaagaccgggtgaaacaataaattcactaccagcttcaattgctgaatttacttgtgctggatttaaaactgtaccagcaccaataatcatttgtggacaagctttcttcatagctataattgcttctttggcacatgcagttcggaaagttacctcagcaactggtagaccgccttcgcataaagctttggcaagatatggagcatcttctaaacactctattttaattactggaactataccatataatgatatatcgttgattattttattcatgttattatcctttcatttttccgccattcattggtgaagtagcaagttttgtgtagattgataaaattccatttttatattttggttcttttggcttccatttagcatggcgctcctttaatatttttgtaatttcttgtgaggtacgttgttttccttcaattccaataatttctaatcgacgttgaggaacatcaattttgatcaagtcattttcctcgattaaagcaattggtcctccctcactagcttctggtgagacatgaccaataactggtcctttgctagctccagaaaaacgtccatcagtaattagtgcaatactcttggctagttcctgatcagaactaatggcttcaccagtatagaacatttcaggcattccactacctttaggtccttcgtaacgaataaatactgcatcaccgggtttgatttgttttttgatgatcgcgtcaatggctgcctcttcgctatcaaatgggcgggccctaagaacagcttgcatcatttcttgaggacatgctgaatgtttgattactgctccatctggtgctaaattcccttttaaaatggcaattgttccatcttttccaatgggatcatcatatggtctaataatatcagtgctttttagattgatcttatccaaaaatgtttggcaattttcatagtaaccattattttttaattcttccaaattttcacctaaagttttaccagtaactgtcattacatctaaattaagattctctttaattgcttccatgaccgctggaacaccacccgcatagtaaaaatattcagccgggtattttcctgcaggacgaatatcaagaagataatgtgcattttgatgcatctgatcaaataaatcagcatttagatcaattccaaactcacttgcaatagctggtaagtgtaacagtgaattagtacttccagaaattgctgcatgaaccataattgcattttcaaatgatttcatggtgacaatatcgcgagctgttaaatccattttggctaatttaattatttgttttcctgctttataggcctgctcttttaaatctttacaagtagctggcattaatgctgtaccaggtaacatcaatcctaatgcttcggtcataatctgcattgttgaagcagtccccatgaaactacaagctccacagcttggacaggcatgatgctgataatactcaaattgctctttggagatttcaccacgtaaatacatggcactatattttccgatttgttctaaggttagcatatctggaccagcttccattacacctccagttacaaagatacaaggattgttaattcttccggctcccattaagtgagcgggcatacctttatcacaacttgcaacaaaaacactgccatcaaagggagttgcattattgtgaatttcaatcataccagcaatcatatctctagatgctagagaataattgataccgtcatgcccttgtgcctcaccatcacaaatatcggtagtgaaaaattttgaggctttagcaccatgatcattgatccctttttcaacctcatagactagatctaaaagaccaacacttccggggtgggagtcaccgtaagtactttcaatcataatttgaggtttgcttagatcggcaacactccatccagtaccaatccttagtggatcaatttcaggtgcaattttacgtaattcttgtgatttcattttatcctcctatgacgtatgacgtcttaaatataatttaattctaaaaggcttgatgatgtttgtcaatagcgttaattaaaattgacaaaaataataaaatgtgtaagaatttataggcgaggcgagaaaatgaaaaaattaggaagtaaaaaaacgctgccagagttggcagtagagcaaattattggctatataaacgaaaatggtcttcaaccaggtgatcaattacctaatgaagttgacttaatgaataaacttaaagttggacgtggaacgatccgtgaagcgattaaaagtctaaattcaaaaggagtcgtaataattaaacgtgggattggaacttttgtggctgatcagccaggaatcagtgatgatccactggggtttacttttgaaactgataaaactaaagttttaatggatgctttggaggtccgattgttgatagaaccgcaaatgattattaaaacaattgataatattagtgcaaaacaacttaaggaattatcagacttagctgatgaaattgaaagcttaattaacaaaaataaagattatactgtacaagatattgaatttcatactttattagctcgggttagcggtaatcgggttattggaaaattaattccaattattgctggagcgattgaacaagctatcgatgtaactgataaatcccttgtccaagaaacaattattacacatcgtttgattgttgaagctgttgctaataaagataaagaaggagctagtaaagcgatggctagacatatccaagataatattgatatattaaagacaatttaaaaaaagcttagtaaagatgagatatcgcctaaagttagattcgataactaacgatcggagattgattgaataaactaagcatttttatttataaggaaattacttacaaatagataactaatcaatgctgcaaggaatttgaatggggcataataaagaatagggataaccaaggggaaaatatttagtagtacatcgataatttactaatttatgatagaaaaaataacctaaagtaataaagaaagaggcacagccaggcggcataaaccgttgttaataaggatatatagattaaaattaagtggtttgaataatttgctatgaataacaattactttaattgctatgggtcggcggattaaattaatacttttattttctatggaactgattctccttttatctattgtaggcacaaaaaagaaagcaattactatttgctttctataagacgattaattcttttctgtttttcactggttaaaagggcctcaggatcattaaggtattggattaaaaggtcagcattttttattaattcgctatatttatcatcaattctttctttatttgaatgattttttattgctgttacaatagtatctatttcatttgctgaaaagagttcatctttttttaatagttctgaggcaattaaactactacgattagcgtgatcaaagctagaattcaatttatatgtagcaagatcatgtaaaatgccgattgttgcagcaatttctatatttaggttattttggattgctagatatttcatcattgcagcaacgctaaataggtgttctaaaccatgtttacgcttattaccaaagcaattagtgtttaaaatttgataaacttcgtccttgattatctcatatcttctcatcgtcttaacccctttggaaaaagattttttacttgattgttactttctttgtaaaatgctaatggataaccatcgacaagaatcaaaccataacctttttggttattaccgattagagtttctccgtgaagatatttggaaatatttaaatcatcagctttaaagttataatagcgtttaacatcttctttttttaaagaaagagccagagaatgacttggttcaaaacgcccttttttacattctcctaaatataaaccattacgtaagacttttgtcccctttagatctgggaattgcggtaaaattgcataaatatggttattagaattatataaatattgggggactggaaggtttaagttattgtgataaaatttagtaacaagatttaattgatctttagtaacattcggttttaagaaatttattttttttgttgaaccattagtatgttttttcaaaagagcaataaattgcccctcacctttattaagatgaggatacattcggacaactttatcattctgataaccagaagccattcctggctgtttttttatttctaataactccatttgtaaatcattggtcatatatttaacttgatcttcattttcttcaagcgaataggtacaagtggagtaaattagaataccttcatctttaagcatttgataagcgctgttaattaaatttctttgaatataagcacactcatttactttttcaattgaccaggtctctactgcttgatcaagtttacgaaacattccttcgcctgagcaaggagcatcaaggatgatcttatcaaaaaaattattaaaatacttttctagtttaactgggtcgctattagttacaattgtattttgaagaccaaaacgttcaacattttcagataaaataccagctctaagtttattgatgtcattagcaatcattaaaccagcactacttaacttactagctgtaaagcatgtctttccaccaggcgcggcacacatatctaatacataatcgtcatgatcaaagtcaaggcagttagctactgccatagcacttggttcttgaatgtaatataaaccacagttaaaataaggatgttttcctaactgataattttcataatcataaaaataagcatcattgatgtagggatgtttggttaaaaatgctgaatttaaatgttcaatacttccatgctttaggggatttaaataaaaacttttaataggtttttgatttaatgcggattcaaatgcaggatagtcattctgtaaaagcttttgcattcgttgttcaaatagtttgttcatagttcacctcttttttattatacaagaattataaataaaaagacaagcatcgcttgtctttaattatttttcattaataatatgacttaattcagccagtcgatttgctaaacggcttaattcttgaattggggcttcaagatataaatcaacatcaattttctttattgcttcttcgtgtttagcgttttcttgtaaaccgactaatgtttctgttgtagcgtctaatgaagtagtaatttcatttaattcgctaataatgttttcatattccataatattacttcctttgtccataattttgttcatccctatattttatactaaaaatacgttatttttattcattcgtcaatagatattctaaaattactaaaacaagtgaagaataagtttgattaaaatttttttctatgacgtaaaaagtgttgatatagagacagtttttttacttgaatttaataaaaatatttttttgttaaattcatttaaatttagtattgcttttattaaaagaattctttataattaattctgttagttgccgttgtaggcacatggttatatgtgaaatgacaattttgccagaatgtcatatttatatatagcataaatttattttgcccgagtgatgaaattggtagacatgaacgactcaaaatcgtttggtttataccatgtcggttcgagtccgacctcgggtaccattgaaataatagccgatactgctgtattggcttttttttataaatatgtatataagtgcactatgttttatacaataacactagtcatctaattaattggccaattgaattggataacttctacatctttattattacatcatatgacagtgatttttgtcgttttttggtttaataggttattttttaaagttgtttggaaatgtgatttaaatatgatactattaggctgacagtgaaagagggataaataattatgaaagtattaaatgttggatcgttaaatattgaccatacatatcagttagaacgaattgttgccccaggagagacaattacatctaaacaaatgagcgtatatgctggtggaaaaggtttgaatcagtcaattgctatagctcgagcagggatagaggtatatcatgctggtaaaatcgggattgatggacagtttttgattgaactttgcaatgatagtggagtgaattctacttttattgaaactggcgtgatacctaccggtaatgctattattcaagtaacttcgcaaggacaaaatagtattattttgtatcctggagctaatcgaagtttagataaagcttggattgacaaagttctgactgaatttagtaaaggggatatattattactgcaaaatgaagtcaatttaatcgattatttaattattgaaggtaaaaagaaagggatgaatatttttttaaatccttcaccatacgatgagtatattgataaatgtgatttatcattagtcaatacttttttaatgaatgaagttgaaggtgcccaaattactggatgttatgaccccgagtgtattttaacaagaatgaaaaatctttatccacaggctaaagttgttttaactctgggacaagatggagtatattttcaagataaggagcagcgcgtgtatcaacccgcacgaacggtcaaagcggtagatacaactggagctggagatacttttacaggatattatatagctgctgtaattgaaggtaaaagtgcaattgaagcattgacttttgctactaatgccgctgcgttagcagtcatgaaagctggcgctgcaaatgcaattccaaaacgtcacgatgttgaaaaatactaggatgatttgatggataggtaatgaagaaagtagtgaaataagatgaataatagtagaaccagagaagaattatttttatttagggatttggcaaaaacaaatatgactgaattcgaacaattgatttctatttcaattggagcagttggaaaaattgtttatgatccacagtttacagtaatatattgtagtgagggaatttctaaattgattggagttgattttattggcagtggtgaaagatatttttcgagcagtcagtttattcatgacgatgatcgtgaatatgtatatcaagaaatcggcaagtatgttaattctaaagagccatttagtttgaaatatcgtttaaaatgttcaaagggtaaagaagcttgggtgcaagctaaaggaatttttttagatgaattatatgaggataaagaccctataatgtatatggtttatactgatattacgccattagtagaagctaatgagcgcctagaacaagaaattcaacggtatcagatttttactgagtttgttcaagaatgcttttttgattatgaaattggatatgatagtttgatgttttatggaagtgatgttaatgataaaaatgatcaagaaaactggtataatatttggagaataaacaaacgattaattttagaacatttttaccaaaataatcatcatcttgataatgatctagaagttgatttaatcgataaaagtaaatgctggtgtcattttcgtgcgaaaggaatttataatacttatcacgatttagttagaatcgttggaacaatgaaaaatatccagtcggaaaaagagcgggaatcaagacgcaaagagtatgaagaaaaattaaaaaataaggcacattatgatcatatgacaggtttgctaaatcgttttgcatgtgaaacaattgttaatcaagtgttagatgaaggattggaaaatgtaacaggagtagtaattgatgttgataactttaaagaaataaatgatctacatggtcattatattggtgatcaagttttgattaaaataggtgaattatttcaaaaatattgtcgcagtgatgatattgctgcgcgtcttgggggtgatgaatttttcttgatgtttcttgggcttatgcagcaagatacgattcgagcaagattacaaacaatgcatcaagagattcataatattgctcgagagctaaaactaaaagtaccagtatctgttagtatgggagttactaaaatatattcaacggataaaacctttgatgatatttatgtccgagctgacgaaacaatgtatcaagcaaaattatcaggcaaaaatacattgatttgttttaatgaggaataataaaaccttaacagataaataaaattatcgttaaggtttttttcgaaacatcttttgttgcttggctagatcagactggctaactaatttctttatttcttgaacaaattcttgctgctgaatcggtgtgagacgatgataaatattgattaattcataattatgaatatatatttgagatttttcagcttcataacattcgtcaccgattgcgcttaaatagccagattgacttaatagatcaactaaactcatttcaaaagcgtgagctattttaacaagtgatggtaaagaaatattataagaaacgccacgatttcctaattcgatattactaatggaggatgctgataaaccggttattttttctaatttggattgcgaccagccttttgaaaggcgagtactttttatatatttaccaattaatgctatatcaatattttccataatacgcctccttttaacaagattataacgtacttaaactattgtgaccgccagaattatgtagacttatatggactataaaatagaaataaaaaaactttttattaaaaaagattgacattattcattctattgtatacaatgttttcaacaacatctgatataaatactgtgaaaagaaatagtaggtattcaaaatagtttagagagctcttggctggtgtaaaagagtctattagagaatattgaattcatcttggagtagaggactgaatcgttagtagtaggtctctccggcaacacccgttaacgtgtaagagtatgaactatttgattagcgtactcgatgaggttagtgtagcaatacattaataaattaaggtggtatcacgaagcataagctctcgtccttttataggaagagagttttttatttatatacagagttgaaataaaacaaaaggggatagaaaaatgattattgtaatgaaaatgacagcgacagaaaaagatgtcgaaaaagtatcaaaaatggttactgacaaggggttaaatgttagtgttgtaaatggaactggtcaatcagttatcggaattattggggatacaactcaaattgatcctaaagcaattgaagtagatgaagcagttgatcatgtaatgcgtgtatctgagccatataaacttgctaaccgggcttttcatcctgatgatacgatcgttgatgttgctggtgttaaagttgggggtgacaaccttgctttgattgctggtccatgttctgttgaaagtgaagaacaagtaatcgagattgctaaagctgccaaagctgccggtgctaatattttaagaggaggcgctttcaaaccaagaacttcaccgtatgcattccagggaatggggtcttctggtctggatattcttgttgcagctaaagaagcaactggattgccaatctgttcggaactgatggatgcccagtatttagaagaattcaatgagaaagtagatctaattcagatcggggcaagaaatatgcaaaacttcgacctgttaaagaaagtgggagcaggaacaaagaaaccaatcttattaaagagaggattaagtgcgacatttgaagaatggatcatgtcagcggaatatatcatggcaaacgggaatccgaatgtaattttatgtgaacgaggggtaagaacatttgagacatatacaagaaacacgttggatttacaggctataccggtagtaaagaaattaacacatttaccaattataattgatccaagccatgcaggagggaaatggtggttagtggaaccaatggcaaaagcagcagtagcagcaggagcagatgggttaatgatcgaagtgcacaacaatccggagaaggcactgtgtgatggaccacagtcattaagaccggaaagatatgaagaattattaaaacaaatttctaaaatagctgaagttgttggaaagaaagtataattaattaggaggaaatataacgatggaaatgacagtttcattaaaagaaaatagctatccaatctatattgaaaaaggaattttaaaccaagctgataaatatatcaaggagatatatcaaggtaataaaatcatgataatttcggatgatcaagtttatcattattatggtgatttattaacaaacgttctaaataaagaatacattgttgagcatgtaacggttcctcatggtgaacagtctaaacgttttgatattttaccatcgttatataaatctttattagattttaaattaacaagaacagatttaatcatcgctttaggcggcggtgttattggggatttagccgggtttgttgcagcgacctttttacgaggtgttaaattggtccaaatcccaacttcattattagcacaagttgattcttcagtaggggggaaagtagcagttgatctaccagaaggaaaaaacttagtgggggctttttatcatccgagaatggttttgattgatccaaatactttaaaaacattaccagagcgttttattaatgacgggatgggagaagtaatcaaatatggctgtattaaagataaaagtttgtttgataaactaaatagttatgataactttgaacagttatacatggatatcgatgaaataatttatcgttgcattggtattaagcgtgatgtagtcgaaagagatcagtttgacttcggggatcgtttattactgaactttgggcatacacttgcacatgcaattgaacaatattatcattatgagaaatattcacatggtgaagcagttgcaataggaatggtacaattaactaaaattgccgaagaaaatgatttatcaccagtggggactagtgatataataaaagaaatttgtattaaatataatttaccagtttatagcggattaaaaacaaccgacttactggaggcaataagtcttgacaagaaaaatattaataaaaaattatcgttagtattgttaaaggaaataggggatagctatgtctatcaaagtaatctttcattaattcaagcaaaggatagggtatagaatgacagcagtaaaaattacaccgactaaattaagtggtgtggtccaagtaccaccgtcaaaatcattagctcaccgagctattatatgtgctagtttagctaaaggaatcagtcgtatcgataatattgaatattctaaagatattcaagcaacaattaaagcaatgcaatcattgggaaccaaaatagagaaatatgatgactatttaatcattgatggcacaactacttatacaaagcaaaatagtgagattgattgtgaagaatctggatcgacgctaaggtttatggttccaattgcaattgttgaggaaaataaagctcattttgttggacgcggtaatttggggaaacgaccgctaaatactttttatgaaatatttgagcgtcaaaatattggttatctttataaagaggatatccttgatctatatgtaattggtaagttaaaacccgatcattataaggttcctgggaatatttcttcacagtttatcactggactgctatttgcattacctctattagatggtgattcgattattgagatcacttcaccgttggaatcaaaaggatatattgatctaactttgcagatgttaaatcaatatggaattaaaattgtcaataatgattataaaagttttattgtaatggggaaacaagaataccaggctcatgactatcgagttgaggcagatttttctcaggcggctttttatctagttgctggagcgattgggaatgatgttgtattaacagatttgaatcttgattcgttacagggagataaagcaactttagaatttcttgaagccatgggggctaaaatttctgtagttagtgatggtatcaaggttacgggtgaaaacttagcagcaacaattgttgacgctagtcaatgccctgatgttatacctgtggtttcagtagctttagctttagctcaaggtaaaagtgatgttattaatgctaaaagattgagaattaaagaatgtgatcgaatcatagcaactcgttcacagcttaatgaattaggtggaaccgtcacagagttacctgatggaatgacgattcgcggtgttaatgagtttactggcggtaattgttctagttttgcggaccatcgaattgcaatgatgttagcaattgctgctactcgcagcagtcagcctgttgttattgataatatggaatgtgtagaaaaatcttatccaaatttttgggaagattaccagtcattaggaggaattattgatgtcatcgacgtggaaaaataatattgagataacaatttttggagaatctcatggaaaagcaattgggattgttttaggaaatctaccaagcggaatcaagattgatttagaggaagtagccaaagaaatgaaacgtcgtgctcctggacaggataaaatgtcaactgctcgaaaagaagctgacaaggtagaaataatgagtgggttacaggatgatgtaacgactggtgcaccattatgtggaataatttataatagtgatcagcattctaaagattattcattattaaaagaaaaaatgcgtcctggtcatagtgattatccagcttttattaaatatagaggatttaatgatgtacgtggcggtggccatttttcaggaagaatcactgctccggttgtttttgctggggctatagcaaaacaaattttggcaaaacaggggattcaaattggagcacatattctaagtattaaaaacgagtatgatgaaaattttgatatgcgtttatcaactaagacacttgaatatttacgcagacaacattatcctgtcattaatcaagaaaaatatgaaaagtttgttaatattgttgatgctgcacgaatggatcaagactcagtaggtggcaaggttgaatgtgcgattattggtttaaaacctggtcttggtgaaccgttttttgattcaattgagagtcatttatcaagtttgttattttcaattccagcagttaaatcagtagcttttggaaatgataagattagtgaattatttggtagtgaagctaatgactgttactattatcaagatgctctagtaaaaactactagtaataacaatggtgggattactggtggaatttctaatggaatgccagtcgtttttacagttggaatcaaaccgacaccttctatttctaaagaacaaaaaacgattgatgtaaaaaaacatgaaaatacaacattaggagttcatggacgtcatgatccttgcattgtttttagagcaactgtagttgtcgaagctatggcagcattagcaatgttggatttggtgaggtaatttatgaaagatttagaacaatgtcgtcgtgaaatcgatgaaatcgaccaacaattgattaaattatttgagcagcgaatgaatgttagtaaagatgttgtcacttacaaattagctcatggattagaaatttttcaaccagaacgtgaaaaagcagtaattgaaaaaaatgctgcacggatgatgaatccagagcttgctgattatgcacgtaattttatgcaagatgttatggatgtcgggaagagctatcaagctacttttattcctctaaataatctttataatttagctgcaccaaaacgagaaaatattaaagttggatatgcaggggtgcctggtgcttttgctcatcaggcgatgttagaatactttggaaatgtagaaaatactaactatgttaattttcgtgatgtttttgaggctttaaaaaatgcggaaattgattatgggattgttcctctagaaaattcttcaactggagcaattaatgataattatgatttagttcgggattacgatttctatattgttggtgagcacagtgtctgtatttcacaacatttattagggattaagggggctaaaattgaaaatatcaaaacagtctatagtcatccccaaggaattcagcagtcagctgattttttaagaaataatcctcaaatgttgtctcaagacttttcgaatacagctgcagcagcaaagtatgtaagtgaatgtaatgatttatctaaaggagcgattgcttcaaaagtggctgcaaaactgtatgatttagaagtattacaggaaaacattcataatgaaaaaactaataatactagatttattatttttgctaaacatcttgaagatcatcctcaaactgatcgggtgagtattgtatttacattacagcataaagttggggctttatatggggtgttaaaagcaattaaagatcaccaaataaatttatcaagaattgagtcgcgtcctataaaggataaacgttggcaatattatttttatattgattttgaaggtagtcttcatgatgataatgtcaaattggcattagaacaaatgaaaacaaattgtcttaccttaagagtcttaggcaattaccatcatgcatagggagaaaagatgaaaaatattgtattaattggcattatgggatgtggtaaaactactttatctagaatgcttggtgaaaaattaaacagaccagttattgacattgacgaatatattgttgaaaaatatcatcaaacaattccagagatgtttgaagttagtgaaacatattttaggaataatgaaactgctggatgtaaagatgtttccgacttaaatgggcatattatttcaactggtggaggggttgttttaagacctgaaaatattaaatatttaaagcaaaatggaataatcatttatattgatcgacctattgataatattttaacggatgttcaagttacaagtcgtcctttgttaaaagagggcccacagaaactatatgaattagataaacaacggcatcagctttatcttgaagcttgtgatcatcgtattgttaatgatgatactttagaaaatattactgataaaattattgagttaataactaaaaataagtttgaggattaatcctcaaacttatttttttctttatttagttttttatttgtatacattttagcatctgcgcgtttgaatgtatcctttaaatcatgatcaattttaggatcataaacagcaaaaccaatagagattgataatttttcatcagtttgttttgaaagctctgtttgaattgctgttacaacagctttgatttgctgtttggcatcatgatgaataagaatgataaattcatccccgccaaaacgataaactgtatttttttggacatgtttttcaagaattttagcaacttttttaatatattcatcaccagtacgatgtccatatgtatcattgattttttttagatcattaagatcggtaataattattccggtattgtgcttatgtgttgataagttttcaaaatctatttcaaaagcattccgattatgtaaatttgttaagtaatcagtattagccatatctttaaaacgaggatttgaaattcttctaaatgatagaacggcaatgatagtagcgataagactagccataatggcaatcaacggtgtaataattcgaatttgtttaaaggcttcaaattgatgactagcatcaaattcaattcctagcacgccaactacttttccttcgtcgtgtatagggtaatatgaaacaaaaatgggaccccaggtagtttccttaatctgatctggcaaaataattttattttttaatgctgctttaagctcaggaattatttctttttcaattttatctccaggataacgaaaatctggacttgcagttggcagtccatcgacaagatagatatattcgccttcatctgtcatttttgcagtatagagatacaaaacatttgttgcattttttacatcttctaatttttgttttatttgtttataagtatcatttttcatatcaagagaaaaattatgattaaaagtatctttgtctaaataattttctacataatgatatatcgtgtttgaacgttcttttagactatagatcatatcatcgtgagtgattttataattaaaaatatagacacaaaaaaaggatgcacaaacaattatgattgtaatgatcgatacttgataatctacccgatcgagccgtttaaatttcattggtttcaacccctttctttgattctaccataaattgactaaattgtgtttagatatgctgattataaaaccaaatattgtcagtcaaagtaataatattcatcctcatcaaaatggtatttatgatataatgtgttaaggtgatagagatgcagttagaaaaacaaatatatattgataaagatttaccagctggctggaaaccatattatatttttttaatgaaagtaaacaatgaaattgtggggcgaatgactttacgagaaggtagttgtgaagaacgatactatgatggacatattggttatactgttgagcccgaatttcgtgggcattattatgcgtatcaaggagtccagttaataaaaccaatagccttaaaactagggtttaaggaactgataattacttgttcaccaaataatttagcttctaaaaaaacgattttaaaattacaagcacaatatttagaaacagtagaaatacctaaaaaatatcggaaagattttgaagccggtgaaacaattaaagaggtttatttaattaaattataaggaggaaaataatgagatttgttcatattagtgatattcatttaggaaagttgttatatcaacaaaatttattagaaattcaagctgatttactgaatcaagtttgtgattatttagtcgataacgaaatagacgttttagtcatggctggagatatttatgatcggagtgttcctagtaatgaagctattgatgttttaaatgattttttaacaaaagttattttaaagtatcacaaaaaagttttgatgatagcgggaaaccatgatagtgcgagtcgattaagttttgttagcggattgctaagacaagaaggattgtatattgaagcatatccggctaaacaaatgaagccgatagaaattgaaggggttaatttttatttaatgcctttttttaaaccatcttatattcgctatttgtatgaagatgaacaaattgttacatatcaggatgcttttcgatgttatcttgaacatcaaaaaatagattttactaaaccgaatgttttaattacccatcaatttattgctggaaatagtgaagttatgcgaagtgaaagtgaaacagtattaagtgtaggtggaacggaaattattgatgtttcattagttaaacaatttgattatgtagctttggggcatatccatgcacctcaaaaaatatcaactgaaactattcgctatagtggcagtttaatgcgttattcttttgacgaagttaatcaaactaaaagtatagttgaggtaacgattgataataaaaaagtatcctatcagcttgtatcattacaacctaaacaagacttaattaaaatcactgggagttttgatgaaatcatggcagattcgtttgccattaataataatgattttattgcagttgaattaacagattcaatgttagtgcctaatgcgattgattatttaagaacaaaattttcaaatgtattgcagattacttatccaaaactaataagtaatgaaacgagtaataatactaaagctgatcctggatttgaaaaacttgattcagttgctttatttgaacaattttatcaaaaaataaaaggtacagaactaagtgctgaagccaaacagattgttacagaaatcatgatgggagggaaagaaaatgttgcctaatcgtcttactatgtcagcatttgggccgtatcatcaagtagtgacaattgattttgagccatttattcaagatggtttatttttgattactggtcctactggagctggaaaaacaatgatttttgatgctattatgtttgctttgtatggagtatcaagtgggagtgaacgtagtagtgaacaatttcgaagtgaccaagctaatcatgatactcctacttttgttgaacttgattttattttacataatcagcattatttaattaagcggtcaccacgatatttattagaaggtaaaaaaacacctaagttacccactgcattattaacattgccgggtggtaaaatgatagaaggaatcaaagaagttaattataaaattaaagaaatcctgggaatcgatgataagcaatttaaacaaattgctatgattgcccaaggtgaatttacaaaacttatttatgcagggagtgaagagcgagaaaaagtattacgcaatttatttaagacagataattttagatgcttagaagaacagctgaaattgcgagttaaagaatataagagtaaatatgatttactttttaaacaaagagagatgttgttaaagagtcttgatgtagaagatgagaaaattgatttagatgaatatttggattcactagaaaaaaagataaagattaaagcgatggagtaccagcaaaatgcacaatattatgagcaaaaggcaaaagagctaaatgtcattgagataaataatcgtcgcttagaatatctagatgatttaaaaatccagctatcgaattatttaagcaaagaggattattatcgagaattagagaagatgatcaaagatttaaaaagagccaatcaacttcaaaatatctattcactaatgattagtagtaaaactaaattagctaagctaagagaaaaagaaaaagtcttaaatgaacgcttatcatttgcaaaaaatgatttaaaaaagcaggagaaacagtatgctttagtctctaaatatcacgatgaagttgctcagggacaaattgaattagaaaaaatggtagaactaaaacaaaatgttttagtatatcaaaaagatttaaatcagggaaataacttaaggaaacagattaaagtaattgagagtaaaaatatcggtttaaatgatagattacaaaaaagtgctaaaattatcgaacgagatagtaatagtattgctcatttagataaacttaagggtgattatgagttgataaatcaaaattatcaaaaaattcatgctcataaacttgagattcataacttaagctctgattatgataaatttttaagagaagaggaacattgttatgagcttcgtgaacagtatcaaaaaattgaagaaaaatatttgaatgaaaaaaataaatatgatcaaatggaacatcattttagatcaagccaggctggtattttagcaagcagtttaaaggaaaatgagccgtgtcctgtttgtggttctttaaaccatccacaattggcagattttgatcaaaaaatagtttatcaagaagatttaaaaaaagcaaaaaagaattttgataagtgtagcgaaacacgaaatgatatttataatgctttaatattaaaacagcaagaagttactttattaaagaaacaaatggaaaatgattgtcagcgcttaggaattgaagaagaattggggaaagaagtttttattaaagtattaggaaagatcaatatcgatgaaaataaattattaaaacaggctaaagaattggataatgaaattatttatttaaataacttaaaaataagtttagctaatcatcagaaggatctagatttattagaacagaatattcaaaaaaataatgcacaagtacaagcttataaagatcaattaaatcaagtcattggacgaatggaacaaaataaacaattaaaagatttaacgcatcatcaggttgatcagcaaattgaagaaaagcaaaaagaattgttaggtttgactaaaataattaaagatattgaagaaaaataccgttctataaatgaacagattattcaattggaagctcaaaataggtcgtattgccagcaaatcaaagatgaggaaaataattatcagcaagtactaagagaatatcgtgggaaactgaatagtttatttacagatgaaaaggaatttttagagattattaaaaacgtcagtcagcttgaaaataaagaaaaggagtatcaggcttatttaattgccaaggattctttgaataaacaaattcatgaattgcaacttgaattaaagggaattgaagttatagatgttgaagtcgtaaaagaaaaactaattattttaaaacaaaaattagattctgctttaaatattttaaataatttaaatgcccaattaatgacagtaaccagtacaatcaagaatattaaaaatattgatcaggaattaagtaatagccatgatatttatcaatgttatttagatttaagtgaggttacatctggaaaaaacagctatcgaatttcatttgaacgttatgttttagcggcatattttgaaaatattctagtttatgctaataccctgctaaaacgtatgtcgcaaggacgctatcagctttatcgtcgtgataaccgctctaaaggggcaggaaagcaaggactggaattagatgttcttgatttagaaagtggacttttacgtgatgttaaaacattgtcgggtggagagtcttttaaagcggcattatctttagctttagggctttctaaaatgattcaaggttatgctggagggatagaattaaatactttatttattgatgagggctttggttctttggatagtcaatcattagatcaagcaattgactgtttgattgatattcaacaagatggtaaattaattggaatcatttcgcatgttagtgaattgaaagagcgaattgatcataaaattattctttcacggaagaacaaagaaacaaagattgctattgaataatcactttattaatagtaaaatagggaaagattataatgaaatgaggagaaataatggcaaataataagaaaaatgatgcaataacggcgatggaagacgattttgctcagtggtatactgatgtctgtcgtaaagcagaattaatggattacagcagcgtaaaaggatttattatctatcgaccatatagttatgcgatgtgggaagcaatccaacaatacatggataaacgttttaaagaaacaggacatgagaatgtttatatgccgatgcttattccacaatcattattacaaaaagaatctgatcacgttgaaggatttgcaccagaatgcgcaatagtaacgaaaggtgggttagatgatctagaagaaaatttgatcattcgtcctacttcagaaacacttttttgtgagcattatgctaaaatagttaattcatatcgtgatttaccaaaattatataatcaatggtgttcggtagtacgttgggaaaaaacgacaagaccatttttaagaggatctgaatttttatggcaagaaggtcatactgttcatgcgagtgaaacagaagctcgggctgaaacattgcaaatgttagaaatctatgaagatactgctaaaaacttattagcaatcccaatgctaacgggacggaaaactgaacgtgaaaaatttgcaggagctgaagaaacttatacgattgaagcactaatgcatgatggtaaagctttacagtcaggcactagtcattattttggacaaggttttgctaaagcgtttgatatgaaatttttatcaaaagaaaataaattagaatatgtttatcaaacatcttggggagtttcaacaagattgttaggagcaattatcatggttcatggtgataataatggtttagttttaccgccacgggtggcaccgactcaagtaatgattattccaattcaacaacaaaaagcaggggttttagataaagcttatgaaattgaaaaacagctaaaagaagctggaataagagttaaagttgatgcaagtgataaatcaccaggatggaagttctcggaagcagagatgcgtggcgtaccattaagattagaaattggtcctaaggatatagaaaataatgcttgtgtaattgcaaaacgtaatgatggaactaaagagaagtatgcattagatcaagaactaattaatacaattgaaacccttttagacacaattcatgatgaaatgtatcaaaaagcattaaatcatcgcaattcaaatattcgtcaagttaacacatatgatgaatttaaaactacattggaaactaaaggcggttatatcaaaatgatgtggtgcggtgatgaggcttgtgaagttaaaatcaaagaagaaactggagcaaccagccgatgtattaaagaagaggaagaagcatttggtgatgtttgtcctatttgtggtaaaccagctaaaaaggttgtgtattttgcaaaagcatattaagatacgaaattttcgtatcttttttgttgttagttgacatatcaactaatgttggtataatagttgacatatcaactaatggaggtgcaaaatggaaagaattggacggattattcatcatttagcaatattaaatcgaaatgatagtaatcaaagattaaaagagtatggattaacaagtaatgaaggttctgtcctaatgtttttgagtcgtcatagtaaggtttatcaagaagaattgattaaagaattacaaattgataaaagtgctgtaacaagattgctccaaaatatggaaaataaagggttaatcaaacgaattcaatcgcctgttgataaacgtttttatttattggagatgacagccttaggtcaagaaaaacagcagatagttgaccagacatttgctaaaaaagattttattttagtatctgggttgagtgaaaaagaacaagaagaacttcgaagaatgttagatgtgatacaaacaaatctaaaaggaggtaaaataaatgaatgatgagagaatgggaaataaaaaaatccttccattattaatagaatttagtgttccagcaattattgggatgctagttaatgcaatttataatgtggttgatcgaatgtttattggaaatgccccacaattaggagcggtagggattgctggaattacaataagttatccagttacattagtattaatggcaatttcattaatggtaggagtaggtggagctactcgtttcagcatttctttaggacaaaaagagaaagataaggcttcaatctatcagggtaatgcaattgttttaacagttgtttttgggctgatgtttactgtattagggaatatttttataacacccatgttagaagttttaggtgctagtaaaacagttttgccatatgccagcgattacttatcaattgttttgtatggagcagtatttcagtgtgttgcaatgtgtgggaataatttttctcgggcacaaggcaaccctaagaatgcaatgatttcacaattaataggggccggatttaatatcgtttttgattatattttaatcattcagttgcatatgggaatgagtggtgcagctatagcgacaattggtggacaattcttaagtatgatttggcaactgtgctatctatgttcaaatcgctctttgattaagttagatatcgaacatatgaaactaaagctgatctatgcgttagatattattaaaacgggaataccagcatttttaatgcaaatggctaatagtgttttaaactttattttgaatagtacattaggaatgtatggtggtgatatcgcaatttcaacagtaggaatcattactagtttccaaactatatgccagatgcctttaacaggtttaatgcaagggcaacaaccattgattagttataattttggggcaggcaattatcatcgagttaaagaaactttaaaatatgcgattatcggtggtacaatgattgcagttgtaggttttttagcagtacaatttttcccggaaactataattagaatgtttaatggtgaggcagaagttgtaaaactaggcacaaaggcaattcgaatttggttcttatttttaccattgttaggggctcaaatcatgactgctaattatttccaatgtattggtaaaattaaagtagcaagtattttaaatttacttcgtcaagtaattattttgattccaatgattttattgttagcgactttctttggtttgaatggtattttctgggctgttccaattgctgatttaggagcgtttgtaattacaattttctgttttataaaagcaatcaaaaagctaaagtaaaaagatttctactctatagaataagacatgaaataaaaaatggattattcatagagtaatttattttttatgaaaaaataataactttattagcattattccctaaaatcgacattaaattctcatcagataaaaaagccatggatagaaatccatgacttacatgcctgattattttaacattttaattgaagtaattacaggctggttagaagcttcaacagttccattattatcagttactggaacagttgtagcaattttgtcaactacctcgattccttcataaacataaccaaaaacagcataatccccatctagtgaagtagttgtttgatgcataataaaaaattgtgaacttgcactatcaggatcagatgaacgcgccattgagattgcaccgcgagtatgttttaaaggattttcaacaccgttagaactaaattcacctttgattgtttcatcagaaccaccagttccattcccttttgggtcacccccttgaatcataaagccgtcaatgatccgatggaaggtcaacccatcatagaaaccttctttaactagttttacaaaattagttacagtaataggtgcttcatcagcttgaagttcaactttgattactccataatccttaacatcgatttcgattcgataattaccgcttaacaaatctttggatgctgttttcttatcttgttcatcattactttttccaccacatccggctaagcttaatgctaatagcataaccattgtaaatttaaataattttttcatattatctccttatatctatctattatttattatacaaaatagtgggtgggattgtccatataaaaataatcaaaactgtcatggttaaaaaatataaaaatgtgataaaatgaatgacaatgataaggggataaaatgagatgaaaagaattgctttaataaatgatgtaacaggatatagtagatgttcgattgcagcgcagctgccgataatttcagcaatgggaattgaatgtgtttttgttccaactgcaatcctatcagtaaacacaatgcatccagaatattatttcgatgattatacggatcgaatgaatgattatattgaaacataataaaaaaatgaaggttagttttgatggaattgctacaggatttcttggttcagaaagacaaatcgatattgtcattgattttataaaaacttttaagaaaaaacatacatttgtattagtagatccggtaatgggtgatcatgggaaactttatccgacttacactactgcaatgcaagataaaatgcgtcaactaataccatatgcgacaattatgacacccaatttaactgaattatgcgcacttttagaggtaccatatccgcatgatataattaatcgggatgagctgattgaaatgtgtcgccaattgtcaaatttgggcccacaaatggtcgttgtaacagggattagtattggtgacgaaattattaactttgcatatgaacaagggaaggaacctgccattatcaaagtaaagcgaataggcgatgatcgaagcgggactggtgatgttatcagcggtgttattgcgggaagttatttaaatggtttgaatttctatcaatgtgttgaaaaagctgcaaattttgcatctaggtgtattgagtatagtcaagcagttggagctcataatcatttgggactatgctttgagcctttcttaaaagaactttaggaggaaagaaaatggtgattttatatacgctacatggtaatggatatattgatttaaaagatctagatacgtataagggaataacttgttatgttaacagcacaaacagatgtagttgtgcatgtactttttgtttacgtaatacaaaagaaatgcttgaatcaaattctctatggttaaaaagggagccgactgtagagatgattattgcggaatttgaaaaatatgatttaacagcatttaaagaagtagtattttgtggttttggtgaaccgttaactcgccacgatgatttaatgaaagttgcaaaatatattaaagagaaaaggtcagatttatcgattagaatcaatacaaatggcttatcatcaattacgttagggcgtgatattgcgcctgattttaagggagtaatcgatacagtatctataagtttaaatgctccaactaaggaagaatattatgaattaacaagagcctgttatggagttgattcatttaactacatgctccaattcacaaaagcgtgtaaaaaatatgtaccaagtgttgttttgacagttgtagatataatcggggtggaaaaaattaaattgtgtcaaaaaattgccgatggtcttggagtagagttaagagttcggccgtttgaagaataataaattgtatcaagattataattatgatagaatttataacagtgaggtaattataaaatgatgcaattaagtcgtgaagaaagaatgttagatgtaaaaagtatgactaatgttcgtgatttgggtggctatgaaactcaaactggtttttatacaaaaagtcataaatttattcgttcaaccaatccaagtaagttatcagatgatgagaaagaatatctttatgattatggaattagaatgcaagtagatttacgaagtgactttgaagtcgaacagttaccaagtcaattaacaggttatcgtgatattgaatactataatgtcaatttaatgcagtctaaagatttaaatgttctccctagtgaagtaacaaattatcaagatttagctggtttttatatttttatgctagaggcaaataaacagcagtttaaagaagtttttgaattgttttatgatcatccatacgatgcaattatgtttaattgttcagctggaaaagatcgtactggggtgattgcggcattattgttagatttagcaggttgtcatgattatgatattgttaaagattattcagaatcatatgaaaataatcttaaaataatttctgaattggaacgtttggttgatgatgctaatcgcgcatttttagaatctgctccacaaatgatgatgaaatttttggactatttgagagaacattatggaagtgctaaagagtatttggtaagttgcggtcttgaagaagaaaagattattgaaattatagaaaattttgtaatttaaaaaaagtaattctcctatttgagttgtatatgataataggaggatttttttatgagaaaaacaaataaactgacatttaaacaaaaacaagaagcagtagcggagctatttaagcagtttcaccgagctaaattgaaattgtattgtttagaaaatactaatttctatccgcagttaaatatcgggatgcttcatgaaaagaaaagtggatacaatgcttcaattgctgaacgcttaaatcaacgaattgatgatagagatgaattggagcgagtggtggcagcatttgaaattgtgattcaagcattaagtcctgagagtcaattaattattacaaatgaatttgttttacagaagaatcatgagtggtggcttgaattttatagtcgagcaacttattatcgtttaaaaacaagagccttggaagaaatattattttatgtaaatatttcataattgtcatatattagcgctttttccttgaaaagactggtattttagatataataaaaaggtatttttaaaaaggagaaagacaatgcttgaaaagatttttaaattaaaagaaaagggaacaacggtcaaaacagaggttattgctggaattactacgtttttagcaatggcttatattttagctgttaacccgaacatgttaagtgagactgggctgtcttatgatggcgttttcttagcaacggcactatcttcagggatcgcaactttgatcatggggttattagcaaactatccagttgctttagcaccggggatgggagttaatgcattatttacatatacccttgttttttcaatggggtatagtcctgcagcagcattggcagcggttgtagtatcaggaataattttcttgttaatttcagttactggggtgcgtaaagcaattattaatgcaattcctcaacaattaaagcttgcgattggagctggaattggattttttatcgcctttattggactaaaaaatgctggaatcattattggaagcgaatcaacatttgtggcgttagggaagttgactgatccagttgtattattagcagtatttggggtcttaataacaattatcttaatggctcgtaagacaccagcagcagtattttatggattggtgattaccgcaattgttggaattgtagctggtttatgtggtatcgagggaatgccggcaatgccttcaaaaattgtttcaattgatttagatactagtgggtttggtatatttatgaatggttttggtgagttatttagccatccggattgtattgtagcattattttcattgttatttgttgatttttttgataccgcaggaacattaatttcagttgcgaacaaaactaatttagttgatgaaaatggtgagttagataatattgaacaagcattagttgctgattctacaggaacagttattggaggaattctaggaacctctactgttacttcttttgttgaatcaacagctggggttgaagctggaggaagaacaggattaactgcttgtactacagcaatattattcttcttatcaattttatttgctccagtacttagtgttgtaactagtgcggttactgctcctgctttagtggcagttggaatttccatggcaactcaattaggtggaattgattgggatgatatcgttttcgctgcatctggtttcatcacagtgatcatgatgattttaacttattcaatttcagatgggattgcatttggttttattgtttatggtattactagtgtaattgctggtagatctaaagaaatcaaaccgattgtttgggctttaattttaatcttcgtagtatattttgctttaatatagtggaaagatacttgtgaactattttaagtaatagtttgtcaagtatcttttattatttaataaatatgatttaatttaaagttttattaataatatatgtgggttagccccttgctggctaagattatttttcaatactttctagttttgaattgattcaatcagctcggtaataaagcaatttgagtggcaaggtcaatcgttgcaattaaatctgtgtttcgttagtataaaaatgtaatcaactattttgattttttactatctaagtaatcttgtttattaatttaccaaaagtagtaacatttataattactatatttcttattttattaatcatttgatattagagaataatattattttttcctaatagctattcaattatatcaagtgttcaatttgacaaagcaaggtaattgtcaatggaaacttactttaaaaaaataaacttagtttctcggcaactatttctaatataatattcaagactttaattatttacaaaaatccaaaaatttaaatataaggcaaaaagtatccaacccatgtaaggaagtaataaaaaagctgctaaaggacggatttgataaaataatttgataagaatagcaactagaatacatagtgtaatcaatattgctagtgctaataaaaaactttggtaattaaaaaaagcgataggccatgcaaaattaatcagtagttgaaaataataaataataagagcagtttctttatttttactattacttcgatgaattagataacttgctaaaccgattaaaatataaagaaatgtccaaacgattgggaatagatatccaggcggagagcacttaggaaggttaactgtttggtatacatccattgcattcattgtaaaaattgcacttaaagcaccgattcccagagagattgatagatttaatataatatatttgtattttttcaattttatcacctatattagtatagacagattatcgaaaaatattaaaaatcttaagaagtgataaagaatgataaatttttttctaatatagaaaaaaacacttctatagaaaagcgctttcatgtataataatagagtgaggtaagagaatgaaattagtatcatggaatgttaatggaattagagcctgtattacaaaagggttctatgatgttttaaaagaaagtaaagcagatattttttgtgtccaagaaacaaagatgcaagaaggtcaaattgaattagaaaagcatggatattatacttatatgaatagtgctgaaaaaaagggttatagtggaactttagtgttttctaaagaaaaaccattaaattatagttatggaattggtatcgaagaacatgaccatgaaggccgcgttgttacgcttgagtatgaaaaattttatttagtcaattgttatactcctaatagccaaaatgaattgaaacgattggactatcggatgcattgggaagatgattttcttgcatacttgaagtctttggagaagagtaaaccggttattttatgtggtgatttaaatgtagcccatcaagaaattgatttaaagaatcctaaaacgaatcgtaaaaatgcaggtttttctgatgaagagagagctaagatgacaaatttattagaaaatggttttatagatacgtatcgatatttatatcctgatcaagaaggtgtttattcttggtggtcatatcgatttaatgcccgtaagaataatgctggatggcggattgattattttattgtttcagattgtttaaaagaagggataaaagaagcgtttatttgtactgatattttgggcagtgatcattgccccgttggattagaaatagatttataagatatgttaaaggagattgtgtcaatggcaccagttacattattatcatttcttactcttttaggaataaccgtatttttctttgcatgtgtagcgtacaataaaataaaaaacaagtaatgatttatttcattacttgtttttttaaattgaaataatccccattgttgataagactgaactaattaatattattaataggccagggacaacaacatatttcatacaaaatagataagcttttttacgcttgaatttagaactgtattcaacttcgtcagtaactgttttaaaaccggttactttgatgataagtagacatgtacaagctgcagaaattggcatcatgattgagtttgtcataaaatcaaagaaatcaagaatacttaaaccaagcggtgtaatgaaatctaaaacaccaaatccaagtgaacatggaatacctaataaagcaattcctccaaaaataagaacacagcatttttttcttgaaaaatcatatcgatcttgaataattgaaacacaacattccattaatgaaattgctgaagttaatgctgcaaacagtactaataaaaagaatactaatccaataatgttaccaaatgacatactggcaaatacttttggcattgtaataaacattaaggaaggaccggcgtttagtgtatctggatttccaccagaaaaagcaaatactgcggggataatcattaaacctgctagaaaggcaattaatgtatccattatctctacttgagtaattgattgttccatatcaatttcacgtttcatatatgaaccatatgtaaataaaattcccatcccgatagacaacgaatagaacatttgtcccatagccgctactactgtcatgattgaaaaacgcgagaagtcaggaattaaatagtatttaaccccttcaatagcaccaggtgtaaataatgcatataaagcaatgaatagagccattgcaactaaagcaggcattaatactttactgcatttttcaattcctttttcaacacctagcataactacgccaaataccattccagcaaagacaagtaaccagatgacaggctgtagtgttgaagatgaaaaaccagtaaaataggtatcactaactaagctggcagaattgtttgtaataaattcaaataaatatttacaaacccatcccccaacaacacagtagtaaggtacgatgagcattggcacgatggcatttagccaaccaccaaattgaagtttttttgcacccaattgtttataggctgcaatcgggctcttttttgtttttcttcccaaggcagtttcactaattagcaaagcaaaaccaaaggtaatcgctaaaataaaatatgtgaataaaaaagtacctccaccatatttagctgctaaataagggaaacgccaaatattcccgagcccgacagcagaaccagctactgccataacatagcccaggcgaccagaaaagctacttcgcttgtgttttgtttccatttttatctcctattattaaattttcatgccttttcattataataaaatttgtctataaaagtcaattaaatggcactaaataggatgtttttgttatgattttgttaatgctgagttaaattagatcaatagtgttatgatataaatataaataagtaaagaagggataaaatatggcacgaataattgcaattattatggccttatttggtcataaagggcattcgtaatttcggtattaaaaaagatatctacgtttagatatcttttttatatattgtaataccatctttaattgtctcaatgatcttaatctgacgaatttcctcgattgcaactttgcaaggattacgatcaaggattaaaagatcagctttttttccttctttaatagaccctttcaagtgttcttcaaaatattgataagcggcattaattgttactccttttaatgcattgtagacagatatttgttcatctgtccccaaagtaaccccgtttttggtttggcgttttacagcacaccaaatcgtttctaacatgtttggctcaataacaggggtatcttgatggaaggtataaggtaaatctaattttaaagcactatgaacacaagaaatagattcagcacgttgtccaagattacggcggtgaatatcaccccaataatagatatgagcaatgaagaaactaggaatcattccaatgctttttagccgcggtagttgatctggtcttaaggtttgactatgaatcattacagggcgtagaggtgtgtactgatcattaaaggcatcaagtagttgattggaagcagcatcaccgttacaatgagttagtagttgcgctttatcattaatagccatatctacgaattttttaacatctgaatctaagtagatcggatatccacaatagtcaccactattttcatatggcttagataaccaggcggtttttccttgtggagaaccatctagaaataacttataaccgcctagtttaaaatgatttaagtaatgatgatattgttgattatcccgatataaagaataattatttttaatatcaacataacctacaacatcgagaaataatttattttctgtcgccaaagagttcaataaatcaaattcatgctgtttcatatatccctcttgcacagttgtgattccatagctagcatagatttttaaggcatcaaggatttgtgtttttaaatttttattttccttgcttccttggcttgcaatcgtaataaaagcttgttcctcaagataaccatttaaatgaccatcctcatcacgtccgtatttaccaccgacaggatcgttaatttgatcagttagtcctagtagctgcattgttttagtattgactacacccatatgacctgatgcatgagccatcataattggattagtggtagaaattttatctaaatcacttgcagtaggatggcattgttctttgagaaaattatgatcatagccaaaacctattaacatttcttctgaagtaggattattttcttcaatataatttttaaaacattgaataatttgagcaatacttgttgctttacttaaatcaacaagtttaagtgtacttgctaaagaaacaacatgactatgactatcaataaaagagggcattaaacattttccttgtaaatcaatgaactcagtatcagcacagactagattttttatttcagaataattaccacattttttaatcacaccatcttctacataaatagcttcataatcactattttccatcgttagaatatcaccattataatatatttttttcatataaacctcctattaatattatagccattgcaaatgaaattaatattaagttaaacaaaaaatcagtttaaaactgattttataaatcttgactttctattaaaacacaattttgataataattaagattattttcattaatcaaagaaatcaaatcatcattataagtacctggctgtaaccagatatgtttgatattaagctggttacattctttaatataatctattccaaattttggactaacaacaaacacagcaacgtcaattttatttttaatggcagttagattgggaaaagttgactttccatcaatttctttataaataggtgaaaccccatacacagttttttctatttcatttaaacgttgataaatcttgtagccaaatttatcaggatttgtcgttacaccgattactgcaaaattttgataatgagttaagatatctttagcattcataatttcagctcctttattttgataaatatattatatcatgataatggcaagatatagtgatagatgcttctttacttataaaagaagctaattttataatactaaaaagattatttttagatgctatactcactaatttatattgatagacatactactatttattattatatagcagtacttagcattactgaatacatggacttataagtagggaggagtagttgacttgaaggatataacagagatattaaaaggaatattagaaggctgtgttttagaaataattaatcaagaagaaacatatggatatgagattacaagacgactcaatcagttaggatttacagaggttgtggaaggaacagtttatactatattagttaggcttgaaaagagtggattagttaagattcaaaaaaagttgtctaaaatgggacctccaagaaaattttattctttaaatgaaagtggacgtgaaaaattacgactcttttggacaaaatgggaatttatgactgataaacttaatgaattaaaggagagtggtaaaaatgaataaattttttgatgattattttaatattaaaataatgataaaaagtaaaaaggaatatcgaacgcatatgaaaagggtagagcaattaccggctgattagcagtgtgttttaaaaaaaattcaagcatatatatggcagtttgtatccgggtcaggatatgatatgcttgaaattcaatagggttacttgaattatttgaagaagggcagcagtacgaagatcagttttagaaataactggagatgatgttgctgattttgtagaagagcttttaaaaaatacaagaacttatccaacggattggaaaagtgaatttaatcacgaaattcaaaaaagcttaaaataaaagcttctaaacaataaacttttataatataaagtaattgatttgataagttaattgtttttattagatactttataaagtaaaaagatgttatatctctttattgtgatataacatctttatttaataattgtttatataaggtgagatcttctttaaaagtattgattgatgcttgccagaatgacttatcttttaaattaatattaacacttgaacaaacatcttctaatgacattttccctgttaaggataataatttttcataagtattgctaaattttgaaccttctttttggtaaatagtgtataatcctttagctaaaagaagaccgaaagcataaggaaaattataaaaagaacaatctgcataataatagtgtggtttccaggtccacatatatggatgaagatattgatgatctaaaccatctccataagcatctttttgagcctgaatcattagttctttgatctcttctactgacaaagcaccagtttctcttttttcaaaaaaacgactttcaaataagtatctagagtagatatcgacgattacttgggtagctcctgataattcatcttctaataagcttagtttcgtctgatcattagctttttttaaagcagctttagttacaattgtttcgcaaaaagttgaagcagtctccgcaattggcataggatagtcactatttaaaatagattcatcatttaaacattcaccatggaagccatgacctagctcgtgagccatcgtaattgcatcagaaaagctgtcaccataatttaataaaaaacgactttccttgatactatgaagattgcaacaaaaggctccgccaactttaccgctttggggataaacatcaatccaattattttcaattgcttttttcgcaaaagtacctaaatgttcagaaaaggtactaaattgattaataataaattggcagcttttttcgtatggatgactgtcatgatcttcgataacaggggcataaagctcaaaccaaggtaatccgttttgatatccaagggcagtagctttagtttttagataatccctaaagacattaaggttttcttgcatcacagttaataaaacatctaatgtttcttttgacattcgtgcattgataagggttctttctagttcattttcatatcctcttaatttagtagtatagagtacttctcctttgattccgtttaaacaagcagcaatagcctgttctttatcttgataactgtttatttctgcttggtaagcttttttacgtatttcgcgatccttatcataggccatatttaaaaccgaagttagagggtaggtttggtcctcgatagttacttcaattgatgaaattaattgatcttttagtttgctaaaagcattactaccagtattttgcatgtgtgcaatgatgctctcactctttttatctaaagtgtatttttgattttgctgaatttcttttaaaataaatagatgttccttgattaagtttgattttaatgaatcaagcttaaaagtactgatccattgttgatttaagacttcatcttcaacaaaagaagctaaaaggttatctagctgatcgctatattttaaagcaatgctatttgttgtatcgactgataaagttaaactaatataattagctactttttcaattagttgatttaattttattaaatcgactaaataattttctaatgatttttcatcattgttattacgatatgtatttatttgtttttgtaatttaatgatttggttaaaatcagtagtaaaactagaatcatcaaatgattgatataatttcgataaatcccattctttcattttctatcacctcgtataatatattttgtaaagattacagcacctttacaatcttaatttcatattggattttcctaagtaataatattctttttcaccttgctgcattctacttaatgagtctgtctttcaattttagaatgaattacctcatcgaatattgtttattcaatatattttgatgcgtagccttgattaatattgttttattcttatggcgagattatgacatatctaaagaacagaggttagtcaagtatttatttttagttatatttcaattgaaaggtgctgattttatgaatacactctatgtagatattgatgaatcaactcaaaacaatcaagtttatgcaatgaactttaatcaggacatttttaatataacttccctaacaatcctgatagatgtgataatcttatcttaactgttaagacttttgtcgataaagaaaaatttgattctataatcatcttagctaatctacttctatatacgactatcatatttgggcttatttaatagagcagctcaattgttattataccaaaatattgaaataaattaacaaactttatgctgataatgatttaattgttttcagcaagaaaaaaactgattagcagcaatgtgcataatttctcatcatgtaaatcaacattggtaagttccttgatcttttctaaacgataaagtagtgtattgcggtggatagccaattgttcaattgttttatgagagtcaccaaaattacaaatatacgattttaaagtatgataataatcattcttagttgattcatcaatttgttttagttttgtaataagtggatggagatatatcttgtatgaactagtagtaaaaaatgattctaaagcaatatcttcaaaaaaagtaaattgctgtttacttaaatcgtaagctttcagtgcttgttgtttataaatattaatatctaacagattatcgaaaatataactaataccaaactttaatttataaatatttacagcagttattaaactttttactttattaataatattgttttttgttgctctattaagcccggtaattaaaatatataagcagttatcttggagataagaatatgtatttggtaaagtaataatatgctgatgaagttgatttaaatacactatctcattgctttttaagcctacctttgtagtaataatacagtaatctctgctaaaattattgggttgtgcaggtaataatttttctaaatcatgtttatttatattgtcatttgagaataagtaattcattattgcaaaatattcgtaacgattataattatagccggttttgctgtgacaaataatggatgcgatagttttagctaatttactgataaaactgaatatttcagatgatggcttgccatctgcaaataaaatgcataagtaaccaataatattatcattgtctgttattgctgcaataattcgtggaattgtctgcccaactccgtaatcgacatagataacattattattttgatccaaatctttttgataattacctaattggataaatgggagcatctcaactgctactttttgatgttcttgcatgtgatcaaagagcatatctccaatttgttgatttggatgttgtgccaaaactacataattcacatcacataagaccattggatgatggaaatattcgtataattgtttcataaattgatgcagattatgatttattaatccattgaatagaaattcatacatatctttcataagctcacctcctttatattataaatgtagttgtgcaatttgcacaaccagtaattaaatatttgtatttttgcccatggtatttttttaacaagaaagataaaatttaaatatcgacggaggtaatttatatgaaatacgatgcattatttacaccttttaaaataggtaatatggaagtgaaaaatcgttttgttatggcaccaatgggaactaattcttcacatattgatggatgtattgctaatgatgaaattgattattttgaagcgcgagctaaaggtggggttggattgatcattatgggatgtcaatttttaaatcctgatttagcacaaggatcattagaaggaatcttacaaaatagttacgttattcctcaattgacaactgtagttgaagcgacacatcgttggggggcaaaaatttgttgtcaaattagttgtggaactggaagaaatgcttttcctaacatgtatggagaaccaccattctcttcaagtgatacaccatcaacatttaatcctgaaatgaagtgtcgtccattgagtgaagaagatattaaaaaaattatgacagagtttgctaatagcgcaataattgctaaaaacgctggttttgatgcaatagaaattcatggacatgcgggctatttggttgatcaattcatgtcgcctgtatggaataagcgaactgatgaatatggtggtagtgctgaaaatagaatgcgttttgctacagaaattgtgcaatctataaaacaggcagttgatttaccagttatatttagaattgctttagatcatctatttgtagagggtagaaccttggatgaaagtatggaattaattgagattttagaaaaagctggggtagatgctttagatattgacgcaggatgttatgaacggattgattatattttcccaactgcatatttaggtgatgcttgtatggattatgtatgcaaagaagcgcgcaaacatgtaaatattccgatcatgaatgctggaaatcatacacctgaatcagcacttcgattaattgaatctaaagatgctgattttgttatgtttggtcgtcaatttattgcggatccagatacagtaaataaattgatgagcgatcatgaagaggatgttcgcccatgtattcgctgcaatgaagaatgtgtagggagaattgtcggacgtcttactaagttgagttgtgcagtaaatcctcaagcatgtgaagaagaacgttttgcaattaagccatgtagtcaagtaaaaaatattgttgtgattggtgcaggacctgctggattagaagctgctagagtagctgctgctgaaggacataatgtggaaatttatgaaaagactaatatgattggtggacaattaagtgttgctgcgacaccaaaatttaaggatcaattaaagaaattagttaaatggtttgaagtacaattaaataaattggatgtaataatacactttaattatgaagtaaaagcagatgatcaaattttaaaaaatgcagatcaaattattgtggcctgtggagcagatgaaattatacctccaataaatggtatcaataatgagaatgtaattagtgtaattgacgcacatatgcacaaaggtatgattaaaggtgaaaatgtcattatgtgtggtgggggattgtcaggtattgatagtgccattgaacttgctagtgaacatggtaaaaatgttacaataattgagatggctgatagtattgctaaagatgtattatttattaaccaggcttcaatttttgcaaagattgatgaatataaaattaatgtgattaccggtgctaaagttattgagtttaataatgatggcattacttatcaaaaagatgaacaagaagttgtttgtaaagcggatacgattattagagcatttggaatgaaaccaaatcgtgaattagctgaagaaattagaaatatttatccaactaaaacaagaattgttggggatagtgaaaaaattggtaaggttgctaatgctatacgtgatggattctatgcgggaatgtctttataaaaatataaaagttcgttatattagcgaactttttatatagctgttttaggtattgtctagtaaaaatttcatataattattctattttttatgaaagtataaaaatcaatctttacttttaattttgttgttgtgtaattttcaaagtaattttaataattgtcattgcgtgaaataaagattatataagcaaattatacatagatgatataataatggaaaaataaaatgaaactatgaaaatttataaaaaatatattagggagtttttaaaaattgaaagagtaaatatgtgattaaataaatatcatcaattaatcaaaatgctttcaaatgattatgatgagattgaagcaaggaagatttttttaataatattaaatttatcattaatttaatattatttctttagtcataagcctattttcaagtgtaattttaaatgtaatgtagttatgtaaaataacgattagattttatttgatctaatcgttatttgttatatagtcgtaaatatcttttcttatctcattttccaatttataagtaaattgaacaacattattgtttgtattggacatagttgtttgaattggttcgccataagcgtgcattagacctaaatagtaaaattctttagaggcttcatcatctttattttttctaataaatagatggattttaacatgattagttttttcactatatattttaactacatcttcggattcaatcgtacgccttggcttagaaaaacaaattatagtattttgatctactaatctatcctcgtatttgatagattcgctaatgccttcttctttatcataattaataaacacaggaaaagtgttggtatgtttatcgtacttatatccacctatattaagtggaactaaatttttttcccaatttaataagcggcaaacatcttcataagtgtattttttatataggcatagtgaggtatctttatatgtattcgtataattttgtttataacgatttattccaaaatcgagtaattcaattatttgttttttaaattcttgatcagctaataacattttaaattgtgcagaagtattgaggttttcatcaataaatatagcatctttaaatgttgcttttgatgagccagtagcaaaattttgacttagaatattaatgattgtctgataagttattttaggtaaattaagattatagttattcaacaaagattcttttaaattatcaagtaaattagtatgtttttcaattgcaattttaattgcttctaattcatgaattcgttttcctgatgcaagtttggttgagatataagtaagatattgttcttgaacagagctgaatttaacattatattctttttcgtattttgttaggaatttatgatatgaacctaaatttttattttgaaaaattcttaagacatcaatagattcatatttatcaaaatcttttaaactaggaattttacctagtttttgttttaattgttgataactttccttaatgattttaatatcactaaaatttgctttatcaatcgattcaaaaattttctttttagaaatcaaatcaaaattaactgttgatgcacctggaataattaaagaaccttcacttacgaatcttcttaaagtatctttgttatagcttagactaccgcttaatgcaataggaatcaaaaagttcttttcataatttccaataaaatcaataataacaacatattctttagaaggatctttacgtagaccacgtcctagctgttgaacaaaaacaattgctgattcagttggacgtagcatgataacttgattaactttaggaatatcaattccttcattaaatatatctactgtaaaaatataatctaagcaattaactaaatcatcactttcaagtctgttcatcgcatcacggcgttgtgcttcagtattttcaccggttaaagatatagtcttgtaaccacgggtattgaataagttagatagttccgttgcttcatctttacgactacaaaaaactaatccccgaacacgatcgcctgaatatccataacgatttatttgttctattatatgcttaactcggtctttggaaacaagattgttaaaatctgttttatcatccagtgattctccattaacttgaatatctgtaataccataataatgaaagggacataataagtcatattccattgcttgttgtagtctaatttcatacgcaatgttataatcaaacattttataaatatcgaaatcatcactacgctctggtgttgcagacatacctaacatgaatttaggggtgaaatagtttactaactcttggtatgaattagctccagcacggtgaacttcatcaataatgatataatcaaaatcatttggattaaacatttcacgatattcttttttatgaattgtctggattgtcgaaaatatataatcagcattaatatctttattgttacctgtgaatacaccgaaactatgattatttattattttttcaaatgacaacattgctgttctagcaatattttctcgatggacaacaaataacattcttttgggattaacatttttcacatcaaaagcacttaaaaatgttttgcctgtaccggttgcagaaataagtaaagccttatttttattttcgtttctaattgattttaatgaatctaatgcagctcgttgcattttattaggttttatttctttttttataatattagtaactgatttaataggtttaacataattttttttatattcttcaatccaatcatttgttaaagaaatagagttttcccattgttgattaaattctttttttatttgttcaacaatatttgtattattggtcgatgaaaactttaagttccattcttggtttattgataaagcagattgggttaaatttgaacttcctacaataatattaaaagtattttcctttttgaaaatatatccttttggatgaaaaccagccttttcatcatcataaattctaacatctaaatttttaaatttaagtaattcttgaaacgtacggggctcattaaatcctagatacgtggaagtaattatttttccaggaatattcttttcttccaaatctaataaagtttgtttgattgttgcaagtcctgacatgctgataaaggcaattgataattcaaaactatcacaagagtttagttgttgtacaagttcatgagatagtttcataccttgtttataatcattaaacaacaattggggttggtatgttttatcaactgtatttagcgcatttaaatttttatgataatcaattgttagtgtcatgtaaaattcctcgtttttttaatgtatcaaatatttgtatgtcggcgggaatccaattaatattttgttcatctaatgaaatccatcttatactgttatggtcatttagtttaatatgattatcttttaaagtacataaatagcaatccatatctaagataaatgttggatatttataattcacattcataaaaaattcttcaataataattgttgtttctagttcttcttgaatttctctaataagagcttgttctccagattctccaggttcaatttttcctccaggaaattcaaacatgccagcaaactcccctttttttctactggcaattagtattttgttatctttttttataatcgcagctactacttttactgttttcatttaattcacactcctagaagctattatatcaacaataggattttatttaaagaaaagagatataaaatattaatatgtgtactttctttatatttagatagtgtataataaagcatacttattaatgttatcattacataaactaatgataaaatacatgttttcattattgtaacctttttgttccagtgatttaaaaaagtctactatttctaataatgaaaaatctttattaatattaaatatactaaaaacaatatttgtgtggtgatttgtataaggaattttatcaataagttcgttatatgtgttccaatttttataaacaccatcaaattcccatattttattacctaaactttttaacagctcttcatcgagttccataatttcattatcaggaaaagtttttaataaatgatatatgttattacaatttttattaaaaaatagtgttgcaatagagttgttacgttttaacgtaatagtatttttatacaaatagttgataaatatccaacccgtaaagttttaattgaggaaatgcaaaagattttataaataaaaaactcaaacaccaaaataggtcgatgtttgagtcttaataagattactccatattctctaataaattattaataaaactatcataattataactatgaataatactttgctgtaacttagcattattaacaatttcaataaagatatcataaaggtgctcaatgtcttgttggtcaccttgttttattgctagtaaaaagataatctgaaccgtatcttgttgataccaggttaatggtttatcgatgatagcaacagcaactttagtatctttagcacataggcgcataggatgtggtaatgcaaatacttcattcatattagtttttgctaaattttcacgttccataacacaatcaaaataattgctatcaacaatattttgtttttccattaattgacacatttgttttaataaagattctttagagtctattccatctaaatgaataaagaggtttttatcaaaaaatttatttgatttcttcattttatttaaagaaattgatgttagaaatttagagattgcttcgatatcttgattatttaaagcaaagtcaacagtaatggtaggaatatgttcactctttaatggtattgtagaaataacaaagtcaatattcaataattctctttttgtataattaataaattcgttatatgaagctttacgaacaattgttatcttatctttaaagaaaacatttaatctagcttctaacattcttgttgtagcttgaccagaaccacagactaaaataacacttttgttttgaaggcttcctgaaaaacaacgctcaatcgcagctccgatatgcaaagaaacataaccaacttcatcttcagttaaaatatagggtggcttattaaagatttttgcggtacacgttaaagtaatatcaaatgctaaaggaaaattagttttaatggtatttaataatggatttcgtttatttaacgcaaatgatttagtatttaagatagatttaaaatgtaaaaagaggtcatgtgacaaaatttcatcattacgcaaatcaaaattataatcaaaatatatattattcaataattcttctactaactccttgattttattatcattatcgactaagtcgtttaattgtgtattggctactaaatgtgaataaatatattttttttcaccttcactaatcgtaatattaaaagtatactcaatttcatttgcaatatcatcaataaaatcagtataattatcatcaattttaatagtattgttcgtattgatataacagtcaaattgaattcttgagatcattaaagcaaaatggatgattaggtttttaaaattaaaatcatttgtttttatatgtgcattttttaatttattagagataatttgtttaagaagatctagatcaattccctcaaaaagagtatattcatcttttgtaaagccggtaacatagttttgaaagttgtacgataaaacattttcaactagacatttgcgtttatcatcttcattaccaattattttgaccccgacattagtttttgagatatattcaagattatattttgaaaaaatagcttttaaagttttaatatagttttgtaacgtatttttactcacatagatattatcagccaaatcatctagactcatatattcatcactatataataataaatttaataaatatttaatccgatcttgagaactgtctaattctaaattactagttcttgtttgttttattgagcataaaaaagtattatatttttcttgatcattgatctcaatataatatccagcttttctttttaattttatttttgctccatttttttcaagaatttcattaattgcctgaatatcactacggatcgttctatctgtgatgtttaatagaactgataactgacttgcagatactatattatcttgtctgacatagtcaaatatttcatttaaacgattgtatggaaacatcattatcacgattccttccttattatgtctatattgtatagataattgtttttttatgcaaataaattatttccaaaataaaatggaaatcttgatgtttataaagtaaaagtttccgttaataagtggaaatagcattgattgaaataaatttagattcgagatagactatagttgtagcaaggaggtagtaacggaatgcttaatgaagattatatatttttggatgtgaaagtgacgaataaaaatcaattattagggtttattgcagacaaagcccatgaatataatatttgtgacaatcgagaaggactgcttgaagatttaataaaacgtgaagcagaatttccaacaggattgcaagatggattcgcaattccacatgcacgtagtaaccatgtcaaaaaggctgcaattttatatttaagaactgatgaagcaattgagtggggaactatggatgataaaaaagtgaattatttattttcattgttagttcctgaacaaaatgaaggaaatcttcatttacagatgatatctaaattagctacttgtttattagaagatgagtttaagaatacggtaaaatcttcaactaataaatcggcgctaaaagattatatattaaaaaatatggaggtagattaaatgaaaatcgttggtattgccgcttgtcctgcgggattagcacacacacctatggcagctaaagccttagaaaaagcaggagctaaattaggttatgatttaaaaatggagcagcaaggaagtatgggtcaggtcaacaagattactgaggaagaggctaaagaagcagcttttgtaattgtagcatcagatcaaaaaattctaggaatggagcgttttgaaggaaaaccggtaattagaattgatattacaacttgtatcaaagctccggaggcggtcataaaaaaatgtgttcaagcaacacaaaaataaaaaagcaatttaacttggcggagtcaaattgcatacacaaaactatagtgagtagtgtgtactctcattataacataaaatatgaaaagagaggtaaaacgaatgaaaaagtttttaaaagatgctaaaggacatataatgtcaggaattggttatatgctacctttaattattggggcatcactagttgtggctattccaaaattgataggggtagcgatgggaatcaatagtcttgatgcttatgcaacaaaagatgggttcttacacatcttatatttattagagcaggtaggttggacaggtattggcttagttaatactgtattagctggtttcattgccttttcaattgctgacaaacctgctattggagctggtttaattggtggggcattagctagtaatacaaaagccggttttttaggagctgttattgctgcgtttatcgctggatatattgtaaaatggggtaaagaacatatcaaattacctgattcaatgcagcaaatgatgccgttagttattttaccatttttagcaactggtgccgttgctataattatgggagttattcttgcgactccactagcctcaattaatgatgctttagtatcgtggttaagagatatgtgtagtggtggaactagccaattgatcctttcattagttttaggagcaatgattgcttcagatatgggtggaccaatcaataagtcagcatggatggctggaaatgttttaatgacagaaggaatttatcaaccaaatgtatatattaattgtgctatttgtattcccccattagcatatgcaattgctactgtaattaagaaaaatcgtttttcaccaagttttaaagaagccggtaaaggtaactgggttatgggatttattggtattaccgaaggagcgattccttttacattagttaaggctagccgtttaattcctattaatatgattggtggagctttaggagcaggaatctgttgtttacttggagcaactgctgatattccgccagttggaggaatgtatggatttgtttcaatcactggtggttgggcttatcttgttggaattattgttggagctttatttattgcaattgtagcaccaatggttgttgattttaatgatgataaagatgaagaagagacaatatcagttgatgatattgaaatagtaattgaataaaaaataggaagatgaaaatcttcctattaaattaaaggagttaatatgaaaagaaaagtacatgtgatccctcattcacattgggatcgagaatggtattttacaacttcaagatcaaaagtttatttaatgaaagatcttaaagacgttttagatacattagagacaaataatgattttaaatattttatggtcgatgctcaaggttcattattagaagattacattaaatggatgccacaagataaacaaagaattaaaaaacttgtcaaagctaaaaaattaatcattggaccttggtatactcaaagtgatcaactagtaatttctggtgaaagtatcgttcgaaatatgtattatggaatgaagtgttgtgaaactttcggagagtatatgaatgtgggttatgttcctgattcatttggacagtcaggtaatatgcctcaaatatatcgccagtttggaattgaagatactttattttggcgaggcgttagtgatgatatggtcaaacataccgattataattggcgtggtgatgatggcagtgttgtttttactacccaaattccttttggttattatattggtggaaatatacctgaagatgataaagcaagtgatgagttttggcaaaaagaatgttttgaaaaagcaggtagccgtagtgctacaaaacatatttactttcctaatggatttgatcaggctccaattcgtaaaaatcttcctgatttgattaagaaaagaaatgaaaaagatcctgataatgaatacattattagttgtgttgaagactatattaaagatgtaaaaagtgaaaaacctgatttagaagaagtgagtggtgaattagtaattgcaaagcatatgcggattcataaatcgattttttcatcacgaagtgatttgaaagtgttaaatacgcaagtacaaaattatgttactaatattttagaaccgatgttaacaatgtcgtatcatttaggtaatgattatcctcatagtgcagttagtgagatttggaaattgttatttgaaaatgcagctcatgattcaattggatcatgtatttctgataacgctaatgaagatgtatatatgcgctataaacaagctcgggatattgcggttaatttagttgagttacattcacgtttgattgcaactaaaatcaagaataaaactaataatgagatcaccttaacattatttaatacattaccaaaaaaacgtaatgatacaattatttttgaaacatatttaccagctgataattttgcaattaaggataatcatggtaatcatgttaaatatactgtaattgaaaaaacagatcttactgactatgttttatcacaaacaattcgattaaatcctagtaaaaatatctatctgcctagtgtagtctatcaagcaaagattgccatcgaagctagagatgtaccagcattaggttatgtgcaatatacaattgatttggatgataaatctaatgacgatcttcaagaaataacaagcatggaaaatgagtattatcaaattacagttaataagcaaggaagtcttgatatctatgataaactagctgattatcattatcaaaatcaagctgttcttgttgaaaatggtgatgatggtgacagcttcaattactcgccgccacgtcaggatttagaaatattttctattaacagtgaatttgattaccagataactggctctagtctttatcaaaagacaacgatcaattataaaatggatattcctgctgatttacaagaacgggctaaacaacagacaagtattaagttaccagtaactttagaagtggttttaagaaaaggttcaaatataattgatctaaacgtacatgtcgataatcaaggattatcacatcgtttatgcatcttatttgatagtgcgctgacgactaaattcaattatgctgatcagcagtttggtttgatcaaacgaccaaacacttatgataaagaaatggagttatatcttgaagggttaggaaaccaggagaaggcagaaaaaccaaaagaattagctaattgggtcaatgatcaatctacttggcaagaaccaccaatatcaattgaaccaacgcaaagctatgttgctcttgctgataaaaatagaggaattgcggttattccccaaggggttcgcgaatatgaaatcattggtgagcaaggaaatcaaattagattaacattgtttagaacatatggttttatgggtaaagaaaatttagtttatcgccccggtcgagcttcaggcgaaagaatcattgcaactccagctgcccagttattaaaagaaatggattttaaattaggatttacaacttttaactgtgatattaataatgctaatattgatactttagccaaagaatataacaccccaattgaagtatatgaatacgcagactttttaaatggcagattgatttttgcccaagaagatgaggaacaaattttaccagttactaattcattatttgaaagtgaaaataacttagttgttagtgcaatcaaaaaaagtgaagatggtgaaggatatataattcgtctatttaatggtaaagatcatcaggatattggtgataaactaacttttaattttgatataagtgaagcatattatactaatttaaaggaagagaagattgagcaaatagatgttgttgataatagtgtagtaattaaatcaatatcacattgtaaatttattacgatattaataaaataattataataaacctatatagaaaattacaatcattatgattgtaattctaataggtttttttattataatcacatattttttattagagcaatgattaaaagtaatagtaggtagttgatttttaaggggctaagttaatatatttttaaatataaaatggtaaaagtattgatatatatttttttattaagatatgaaaaggggaaaagtgcgtaagtgagaataaaattaatcaaaaaataaaaatgtaaatatagatactataaatattagtattaatcctaaaaaagacgcctatttaatatagtattaaacataattaaaaaatatttttactagaaaataataacagttaatttttgttgttattaatgtaagcgcttttgcttatgagataaatatatattataataaaaatatgtaaaaaaatggagagtatagagatggatgtatatgaaataaagataaaattatatttattgaaagatataaaaattgaagaaacacagacttatttagcatactttattgatagtgtaatggttaaagataatatgtttttaggtatacatgagactaatcagtataagttttatacttttgatagtttgtatcctttagctaaaaatggggtttatcaaaaagataattcgtatatgtttagaataagaacgttagattatcaattagctcaatatttatatgatactttagctaaaaatcggactaaagaatttcaaggtctgaccgctgaggttaaaataattaaaccaaaattaatcaaaaaaatatatacacttacaccagtgattttaaaaacagagcagggatactggaaaaacagcattaaaacagaggattttgaaaaacgattaaaaactaatttaattaaaaaatacaaagatataactggtgaagaaattaatgaagattttcaattatattatcaaattaattttaaaaataaggttccggtatcgagaaaatataaaggaattaaattattaggggatatgattgaattagaaattgcagaaaatgataatgctcaaaaattagcttttttagcaatcggatcaggtttgttagaaatgaacgctagaggatttggatttgttaattacatatattattgaaaggaggttatataatgcttgatgaatgtttacgaatttttaagcaagagcttaaagataatacaaatttagttttaaatacaataattttggctgacggggattatgttttagtacatgatgatggtacttatgatgtagaaaaaattaaatattcaaaaaaagatcattgttttattgaaaaacctgaagatgatctatatgaaaaattatgtttttatgattatcaaagtcaagtaatagatacccaaaaaacttttgatcttcctcataaattaattctttcaaataactatttatcatattttgtaaaaaaagaaaaattgaataataaaaagaaaattaatgatgcaactgaaaaatattttttagcattaagtaatcctagagctaagtataatggtaaagatttagagatgtataattttgtgactcaaaatatcagcgaagttgataaaagaagattattgcaaaataagcagtggttaaaacaatatatttataatttggatggtgttgattataatgaaaaagattatttaaagattttttttgaagcagattatcatcaatatattaatgaaggaaaccgttatcttttgacaaaaatatttaactgtaacgattataacacttatgaaaatgaaacagtgtatggagtaccaaattataatatgcaattaaattctaacaaaccatttttaaaaaatatgacaagaatgcataaagttccatttaaactttccttggaagaagcattgatacaaaaacagttttttgattatttattaaattatgctaataaaggtaaaacaaatatctatattagtagtaatgagaatgatactaaaagaatttattttttagataacaccaaaaaaataaaaaagggatttaatgggctttatcttaaaattaaaaaagacaaagaattaaaaatagagtatatagatacagttactgattataaagaatatttaagtcctatgtttaattttcgaaatgtgattggtgcttttgatgatgaatactatcaagagtataataaaagaaatgaggtagaaaaattacttaatgatgtcttgttttccaagtttttaattaataattattttacggatccagatagtataataagtattaagggtgaaaatattgatgtttataaaaagaatcttattacgtgtagagaagcaatttttgcttggatacatgtaggggcagtgggaaatattaaaaatattttgccaaaagcagcgttagaaacaacgattcactctataaaaatgggacatattaaattggctcaaagacaatttaatctttattttgctataaatgaatattttaataaacaggagaatggtatgaaagatctaagagaaagtattagaacaaaaataaattcccaacagcaaatgaaaatagaaaatgatttagaatatagttttgcagttggacaagcaatagcttatcttcagtcaaagagcaaagctaagaataaaactcaagattttattaatcaatttataactattaagagagatgattctatgaaatcaaaattgaaaaatttatacttacattataattatgctttatctacaggtaagacacgtttcaatatgttgtttgggatgattatggaatatcagagtgatcaaaaaataaatcaaaacatgttgattgctggttatattggagaaaacttaatttatgaaaagggagaaaacgaaaatggataaaagagtatatggagtgattggagtatcatcaaaaatggcaaattggaatgctgatttttctggctatcctagaagtctatctgatggaacgatttttggtagtgacaaagctttaaaatatccaatgagaaaaatgtgggacaatgaaggtaaaaaggtattatatatgaaatctatgaatttttcaaaaaaaaatgatactataacattagtaccaaattcattaaaagagagatatgaaaaattatttgctgttgatgatttaaaaaaatgtaaagataataaggaagtattaactaatttaatgactgctgttgatgttaaaaactttggagcaacatttgcagaagctaaaaataatatttcaattactggtgctgttcagtttgggcagggaattaataaatatggtgatagtgatcttgaaacaatgcaaatactatcaccatttagagatacaaaagatgcagaagcaaaaaattcaactatagggactaaaaaaataatcaatgaagcacattatttctatcctttttcaattaatcctagtgcttataaagaacttgtggctttaggagtcacagatggctacactgaagaagattatttaaattttaaaagaacggctttagtagcagcaacttctttttcatcaaacgctaaagaaggatgtcaaaatgaatttgctttatttgtggaaactaaattggatacatatttaccaaatttaagcgagtatattagttttgaaaaagcagatattaataaaattaaaattgaatgtaacatgttaaatgaattagaagatattttaaatattgaaatttattataatcctgaaacaacagttttagaatctaatttagaaaaagctaaaatctataatttgattactaaaaaagaggtgtagatatgcaagcacttaagtttactttaagtggtaaaactgctttttttaagcgaccggaagtaaatacgtattattttacttttggtaatattcatagagttgcgctattaggaatatttggggcaattttaggttatcagggctataataatacaattgaactaccagagttttatcaaaaattaaaagatatcaaattatctattttgcctcaaaatgaaaagggttatttttcaaagaaaattcaatattataacaattcagttggttatgcatccaaacaacaaggaggtaatttaattataaaagaacaatggctggaaaatgtttgttgggatattgttgttttgttggataatgaggaggcgaataaattagctaaagctataataaacaaaaaatgtatttttataccctatttaggtaaaaatgatcatccagctaatatcactgatcctgtaattgttgatttacaaaaacgtgatattgataaagaaacgcttgactgcttatttccttcaggaaatttcaaaaaagcagaggatgtatatgttaatttttataaatatcaagaaagtttaccaattggattaaatgaaaaaacgggattgtatgagtatatgacatttattcatacgaacttttatgtggataaaggtgcagtatatagttttaatgataaaaacattgtattttattaacccgctattaagcgggttttattgaagggagaatattatggatatcgataaatatctagtttcgctagaaaaaataataattaatattgatcagtgctatggacatagagatgatgatcatcaagaaacaattaatgaacatattcaattatgcacgaaatatttaaaagagatatttaaattaaagaaattggattcaattttaaaatcttttaacatttctttaggagaggggttatcaaatgaaggaaaagaaatgtttaatgagttattttttaacacaattacctttcatgataccggaaaaataaatccgttttttcaaaaaaataaaatgaataatccagtaatgaattatttaaatccgccaaaaaatttaaaatctgatcattcgaaattatcggcatacatctatttaggaacttatttaaataaattgaataggttatcaaggaatgatattggattaataaaaccgattgtttatataaatgcatttgttatttctcgacatcatgctaagattgatgattttagaacatattttatggataaacttgacagtgatgatattttggaaaaaagaattattgaatggatgaacgatgagaaatttataagtcagtttactgagaaattaagtctcgattcattgaatacagatgagtataattatatatttgaaaagctagagaaatatgaaatgaatatacaaatagatctatatgcttatgttagattcttatattcacttctggttttttgtgattattatgcaacaagtgaattttatggtgataataaaaacaatgtaatgcttaaagatgctgattttggtgaaatcattgaactatatgataatagtgaattagttactaagattagaaaaaatgatattggtaaagaaaaaatcaatgcattaagaacaaaagtattcttagaagcggaaagaaatttactagaaaatattgataaaaatattttttatttagaagctccaaccgggagtggtaaaagtaacacagcattaaatcttagtttacgtttaattgaaaatgatgatagtttaaataagataatatatgtatatccttttaatacattagtagaacaaaatctagcatcgttaaataaaatttttggtaatagtaaggctatgaataatattgctgtcgttaattctacaactccattaaaaaaggatgaagatgaaaacttttcggatgaatatcaaaaagcattattagaccgtcaatttctaacatatccaattattctaacgacccacgtaggtctgtttgatactttctttggaaataaccgagaatcagcgtttggtctatgtcaatatgcaaattcggtaatagttttagatgaaatccaaaattatcgaattgaaatatggaatgagatgatcatcttcttaaaagagtttgctcaaattcttaatctaaaaataattatcatgtcagcaacattaccagatttagaattacttacagatgatcgtagtaattcagtttcattaataacaaatcctcaagaatattttttaaatccaatttttaaagatcgagtaaaaacagattatagtctaataaatgtagaaaatactgaagaagcgttattaaatcatgttttagagatgaataagctaaagaaaaaaataatgattgagtttattgttagaaaaagtgcagaaaagttctatcgtcaattaaaagagatagaattagattgtgaagttttatttattagtggttttgatagtgtattagaaagagaaaaaatcattagtactgttaaaacttcaaaacatcttattttagtagcaacccaggtaattgaagccggtgtcgatattgatatggatatcggttataaagatatatctaaacttgatagtgaagaacagtttatgggaagaataaatcgctcatgtaaagaagatggaaaaggaatagtatatttctttaatttaaataaggcaaccaatatttataagggggatgaacgtgttgcacagaaaaatttaacattgtttaatgatgatatgaaaaaagtattgttaaaaaagaactttaattattattaccaaaaacttcttaagactctagcaaatagagctaaaaagcctgaagaaaaaaatgttcccaatttttttagagaaagtgttgcgtgtttagattatcaggcagtaagtaaacgaatggaattgatattagatactagagatcgagtaacgatatttttaggaagaacggtaattaatattgatggggaagaatttgatggtaaagatatttggaatcagtatgtagatttattgaaaaataatgaaatggattatgctaaaaaagtatatgagttgtcagtggttaaaagtatgatgaattattttatgtatcaagttattaaaaaaaatcaatttgattttaaagagcaggttggagatatttattatattgaaaatggtgatgattatattttagatggtaaattaaatacagccctttttgaaactgaggatgagttatttatatagaggtaagaatatggaagtaaatggaacattaataaactattattttcattgtcaaaggcaatgttatcttcatggtaatcgacttaatttagaggatgaaagtgaaaatgtgaagattggtaaagcattgcatgaagaaaagtataaagatgataagaattcagagattgcaattgataatattaggttagataaattaactgcaaaatatttaactgaaacaaaaaagtctgatgctgatttagttgcagcaaagtggcaactattatattatcttaaaattttaaagtcaaaaggaataatacgaaaaggacgaatagaagtaattgaaaagaataaacaaaataaatcttttattgaagtggagctaacagaaattgaagaaaaagaattagataaaattgttattaaaattaaagaattattagaaaatgatcaaataccaccagttttaaatgaaaataaatgtaaaaaatgtgcatattatgcatattgttatatataggaggtgttgtaatgaaaagtactaaatacataactagtatgggagatttaaaacgtaaagatgattcgctttgttttagaaaaagtggtaagaatatatatttaccagtagaaaatataaaagagatatattgtttaaatgaaatttctcttaatactaaattattagattttatctcatctaaaaatataattattcatttttttaactattatcagggttatagtggtaccttttatccaaaagataaatatactagtggtaaattgttgattaaacaggttgaaacatttaataattatcgtattgatattgcaaaagcaatagttaatggtattgcaattaacattgatgaaactttatatcactattataagcatggtaaaaatgaggttaaagaaacaatagactggttaagaaaagaggtgccaaaacgtttaaaaaaagcagaagatattaaaatgattatggcggttgaaggagaaatatggcaacgtttttatagtatgtttatatatatattacctgaagattttataatgaacaaaagagtaaagagaccacctgataatccaattaatgcactaatttcttttggtaacactttactttatacaaaaacaatttcagcgatatatcaaactcacttaaatcaaagtatttcttttttacatgaacctacagaacaaagattttctttgtctttagatttaagtgaagtatttaaaccgatcattgtttttaaaacaatctttgaattagtcaatactaaaagattaacggttgagaaacattttgataagaaaactaattattgtcttttaaatgataaaggtagggatatatttattgaagcttttgaaaatagaatggaaactaaatttttacatactaaattaaagagaaagataacatataaaacagctattaaatatgatggttataaattaattaaaacaatttttgaaaataaattatttataccattttctataaaggataaatattaatgaaaataaaaaatcataactatgtaatcgtctgttacgatattggggaaaaaagagtaaataaaatatttaagatatgtaaaaaatatcttcctcattatcaatattctatttttaagggtcctattaccccttctaaattaattttattaaaaaaagaactaaaaaaagctataaacaaagaagaagattgtgtaagtattattaaattacagagtgaggattcatttgatgaagaaattttagggagtcaaaaagagggaaatgaagatagtttaattatataatttaccaggctcaatttctttttaatgtcctaaaactgttgggagagtaagcgtttaagagaattttactagcaattataaaaaagtaaaatcatttggtaaaaaagtagaaaagtattgatagatataggttttgaggtataatagaaagtgtaaaatggcttatttactagggtttaataacaacataagatgtattgaaatccctataaatgcaggggtacctactaaaccaccagcgtttaataacaacataagatgtattgaaatgtttgtcaatgttggagcagatggtgaaggcggcaggtttaataacaacataagatgtattgaaattgaccaaaagttggaaatacatctctaatcgctcctgtttaataacaacataagatgtattgaaatatggaatcaataattgttgttccatttgataattgggtttaataacaacataagatgtattgaaatctgagactggaacatgatttatagatttcaacagagtttaataacaacataagatgtattgaaatgataattcttcaatcaatgtttggtaatcattgatgtttaataacaacataagatgtattgaaatatgaccacaaagacacgctcggattagcagtatacgtttaataacaacataagatgtattgaaattatgacggctatgaagaaaatattactgtaacaaatgtttaataacaacataagatgtattgaaatggtaaaggaagcaatgatgatacagtaaaactgcgtttaataacaacataagatgtattgaaataggtaggtgtctgaacacgtccaattgacaatggtgtttaataacaacataagatgtattgaaattgtattaacttatagttatctatagtagagtctaagtttaataacaacataagatgtattgaaatccttcacgtttattgctagttataccattttttccaagtttaataacaacataagatgtattgaaattgacattagcaattgggtcaagtagggcctttacagtttaataacaacataagatgtattgaaatatccaaggtgaattaggtaataatctgcttttcgcgtttaataacaacataagatgtattgaaatgcattagttttcttaataaagctgaccggatccatgtttaataacaacataagatgtattgaaataacatttctttagcgcttaattcttctatcattttagtttaataacaacgagatattaaagtgaaaaaacatgactattttgttcatattactattaataaaatatttttttgttataataaaagtaaaagtaagtagaagtggggtaattatgacaaataagtatagattaaaaataatatataaagatactaaattgacattagacattgaggaaaatattacttttgatgaattaagctcaattattaatgaaaaattaatgctaagtgattcgagagcttataaatatcaaaaagatgatgatattattgttacaagaaaaaatagtaaaaacaataaactagcagatcttttagaattagatcagaagttagtttatattattggtactggtaataatgtttatagtattaatatcatcgtttgggactacattattgaagctgataaaaaaatattagagaagtttaatcaaatgttgaaaaatgtcaaacaagtacgtcctgaacaagtatattatttaaatagtagtcaaagaaagtttattgacggtcttttggctgactgttatgaaatgttgaaagaaatgagttttagtggaatttataattaccgcttatttaaaaatggtgctgattttttaacaacgaaagtcatctattatattcttgatgataaatatgaaattcatttatataacaataatgatgatttaaaggaagataatacagaatatttaataactttttatgatactaatcgagcttattttaaaggataccaaggagttaatcgtaatattttcattcttcacaaagataaaacaattaaacaaaatgattttgaatatctttatcacgctttaaatcgtatcattcatatgttcaaggatggtgatgaagatacattatttgaaagccatgaaacatgtttatgttatgacattgcaactaataaattttggactgaataataaaaaagcatcgtcttattatactaacgataagatgatgtttttattcagaatgatcttcaaaatttaaattttcatcaaagaactctttaccaacaactttctttttatcacgggcatcttctactaacttagaaattaaatctttaacttctcgagcattttttatattctttaaatgaatttcacgttcactgtcagctttagtgtacaaaattactgttccagtaccaaagattttttgtgataaatttcttcgtagacataaatcggtaatacgatacaaaagcaattcgtcatagtgagtactaaataggccagtctcttgatataggcgatcattttttatttcatatttagtaaaactaattggaaaccacataaaatgtttacgatcttgccaaataattttattttccatcataagttcctccaattacaacattttatctatgatgattataacagtaaagagtagtcaattctatgattattgaaataatctcattataaataaaaaaataaaacaaattatgcaaataagtttgtatatatcgcgtaattatgctatactcaccaaagtgtctagaaaggtataaagaatgattgaaaacaaatttaatgaattaggattaagtaatgaagtattaaaagcaattgaagatatggggttttctaaaccgtcaaaaattcaagaagaagcaattcctgtattattgacaggagttgatgtaattggtcaagcacaaactggtaccggtaaaactttagcatttgggagcgttttgttgtcaaaaataactccatctcaaagaaagttaccacaagctatcattttgtcaccaacaagggaactagcaatgcaaatccatgaagaaatggaacgtattggtaaatataatggaagtcgaattacttgcgtatacggtggtagtgatatagagcgacaaattcggaccattaaaaaaggaatcgatattatcgtagggacaccagggcgagtaatggatttaatgcgtcgtaatgttttgaaactaaacgacgtaaaattcgtagtattagacgaagcggatgaaatgttgaatatgggctttgttgaagatatcgaaactattttagaaaaagttgatgatgatcgtcaaacaattttattttcagcaacaatgccagcaggaattaaaaagattgctcaaaattatatgcatgataattttgaacatgtagctgtattatcaaaacaaacaacagctacatctgttaaacaattctattacgaagtgaaacaaaaagatcgttttgaagcaatgtgccgtttaattgacgtcgctaatgttcaaacaggaattattttttgtagaacaaaacgtagtgttgatgaagtaactgaacaaatgcagcaggcaaattataatgttgaagcgatgcatggagatttatcacaaaatcatcgtatgaatacattgagaaaatttaaaaaaggaacaattaattttttaattgcaactgatgtagctgctcgtggtattgatgttgaaaatgtaacacatgtaattaattatgaattaccacaagatattgaatcatatgttcatcgaattggtcgtactggtcgagctgataaagaaggacaagcttattcaattattacaccaagagaaaaaggatttttacgtcaaattgagcgtgtaacaaaatcttctattaccaaagcgactattccaactctgcaagaaatttctgaagcaaaaattggaactctggtaagtaaagttgaagatcaaattttggctggtaaccataagaagttcaagcaattggtaaatgaaattgatccaacaatgttagcagactttacggcagcattaatgtatatgacattccaagaacagttaggatatgattataaacgtgatacgattcaggaggcttctgaaggtaaaaggcgtgaacgtggccgtggaaataataaagattatacaagaatttttattactgctggtagtatggatcgtgtcaaagcaccacaaattgttaatttctttgtttctaaagcaggtgtgagaaaagaagatatcggagatattgatatcaaacgaaaatttacatttgttgatattaataagaaggtaatcaataaagttgttgataagtgtaataagcaaaagattaataatcgaaagattgaaatcgaaattgcaaataaaaaataaatatttggtgaaaagattgtgttttaaaaatacaatctttttttgtataaaaatatggtattttaaaagcgcttacacttgaatgaaaaggctaacacgtgtataatatatttatgtattaattctaaggaggattagattgaatgaaaaaatacgtttatatgtttagcgaaggaaacgaaatgatgcgtgaccttctaggtggtaaaggggctaacttggctgcaatggttaacttagggttaccagtaccacaaggatttacagtgactactgaagcatgtaatgaatattatgctgatggtaagatcatcaatgatgaaatgaaaaaacaaattgatgactgcttagaaagattagaaaaattagctgataaaaaacttgggggattagataatccgttattagtttcagttcgttctggagcaaaattttctatgcctggaatgatggatacaattcttaacttaggtttaaatgatgaaactgttgaagttgtagctaaacaaacaggaaatcgtcgttttgcttttgatagttatcgtagatttattcaaatgtactctgatgtagtttgtgaagttgataaagagttatttgaagctaaattaagtgaattaaaaacttcaaagggatatgaaagtgatttagatatcactgcagaagattttgaaaatatcattattcctcaatataaagaaattttcaaaactcaattaggtagagactttccacaagaagctaaagaacaattaatgggagcaattttagctgtattcagatcatggaataatgatcgtgctattatttatcgtaacttaaatggaattcctcatgatttgggaactgctgttaacgtacaacaaatggtatttggtaatatgggtgatgactcaggtactggggtattatttactcgtaatgctgctaatggggataatcatatttatggtgagtatttaattaacgctcaaggtgaagacgttgttgctggtattcgtacaccacaaaaaattgctaaattagaagaagatatgccagaaatctataaacaattagttacaattgttaaaggattagaaaaacattataaagatatgcaagactgtgaatttacagttgagaatggtaaactatatattttacaaactcgaaatggtaaacgtactggtaaagcagcattaaaaattgctgtagatttagtacatgaaggtttaatcaataaatatgaagcaatgacaagagttgaacctgatcaaatctcacaactattacatccgaactttacacctgctgcattagctgctgctgaagtgttgattgaaggattacctgcttcaccaggtgctggtgctggtaaagtttatttaactgctgaaaaagttcatgaacaagctgtagctggtgaaaaagttattttagtaagacacgaaacttctcctgaagatattcaaggtatggttgattgtgaaggtattttaacttctactggaggaatgacgagtcatgcagctgtagttgctcgtggtatgggtaaatgctgtatcgtaggtgcaaaagcattatcgattgattatgatgcaggaacatttacaattgatggaaaaacttatccagaaggaacagaaatttcattagatggtacaagtggtaaagtatatatgggaattttagattctgaagaatctgaattaacaggtgattttgctgaattgatgtcttgggctgatgaaatcaagaaattacaagttcgtgctaatgctgatagccctcgtgatgcggctgtagctattaaatttggagctgaaggtattggtttatgtcgtacagaacatatgttctttgaaggagatcgtatcgaatatgtaagacaaatgattttatctgatacagtggaagaaagaattaaggcattagatgagttatataaattccaagttgaagacttcagaggaatctatcgtgcgatggttggattaccggtaacagtacgtttattagatccacctcttcatgaatttttaccacatactgatgaagaatatcaagcagttgctgataaacttggaaaaacattagaagaagtgaaaactaagggcgcaactttaaaagaaactaatccaatgttaggacatcgtggttcacgtttagcagtaacgtatccagaaatctataatatgcaagttagagcaattattgatgcagcgattgatgttgaaagagaattaggatgtacaatcgtaccagaaatcatgttaccattgattggtagtgaatctgaaatcgtttatgtgaaagataatgttacaaaagcaattgatgccgcaattatggctaaaaatgcaaaaattgaatataagatcggtacaatgattgaaattccaagagctgctttaacagctgatgaaattgcaaaacatgctgaatttttctcatttggaactaacgatttaactcaaatgacatttggtttctctcgtgatgatgtaggaagtttcttgcctgaatatattaatcgtaaagtaattcaagttgatccattcgtatcgcttgatcaaagtggtgttggtcaattagtagaaatggctgcaaacaaaggtcgcagtgttcgtccaaaaattaaattaggtatttgtggtgaacatggtggagatccagaatcaattaaattctgtcataaaacaggtttaacttatgtatcttgttctccatatcgtgtgttaattgcacgtttagctgctgctcaagctgctgctgaggaaattatcctagaacacactactgataaagtattagttgctgataaatagctgataaacgtctcttaatttaaagagacgtttttttatttgtgtaaagtaggatatttggtataatagatatggtgataaaatgaaaaatattataattgtagcaacaggtggaacaattgcaggaagtggcaaagttggaaaagcaactaattatcaggctggaaaaatcaatattaaggaaataattgactctattccaatgattaatgaagttgctaatttaaaagcaattcagctttttaatgtcgatagtaatgagatgaatgaagaacattggataattttagctaataaaataaatgatttggcttctcaaaaaaatgttgatggtattgtagttactcatggaactgatacattggatgagacagcctattttttaaatcttacaatcaatacatataagccagtcgttttgacaggggcaatgagaccagcgagtgcaactagtgcagatggtccgattaatttatatcaagctgtttgtttggcttcgtgtgatgatgctttgggacatggcgtaatggcagtcttttcaagtacaatttattcagggcgagatatccaaaaaattagtaattttaaaactgatgcatttgatcaaaaagattttggatgtttgggttatatgaatgatgataaagttatgatgttttcaagaacttttaaaaaacatacattgcaatcagtttttagtgaaaagccaattactgaattgcctccggtagggattgtctattactatgctggtgctaaacctgatattttgacgatgatggctcagaatcatcgagggattgtgataattggcagcggtagtggtaattatagtcaagcatggctgaatgaaattgaaacactaggtgctcaaggaatcatttttgttagagcgtctcgggttaatcagggaattgtatatgagagtgatgtttttgatcctcataatgtctgtataccgtctaatactttgtcaggacaaaaagctagagtgcttctaatgcttgctttaagtgttactcagaatacaaaagaaattaaaagaatttttaatgaatattaaagggggcacatgtacgtggaacgaatcaaacttaatttagatagtattgcaatgatgctgttttgtgctcgattaaaagcgtataaagaggtcccactttctaatgaggaatggttgttaattgagcggattataaaaaagaaggggttaaaaggacctgctagtttgctgtcgatgaatcagacagaacttgaagaaattttagaaataaatgaatttattgcttataaaatggcacgaagaattgaaacgatgaatattttttttagtgttcttaataatctggagggaaatggaattaatgttactacaaaatatgaagataatttccctaaattgttaactaaacacctaaagaaaagggctccattatatgtgttttattgtggtaatattgaattagttggagaaggaatttctttgatgggtcttaataaggttactaaaaaagatcgcgcctataccaaaagattggtagataaagcaattgaagataatctaatttacatttccaatgatgctaaaggaattgatgatgttgctttgcattacgcactttatcatggttgtcattgtattagttttgtttgtgagcgacttggtgctaaaagcaaagactatactagatatattaaatccggacaattagtgatgctgagtgctgaggatccaaactgctattttgatgtaactaatgcaattgagcgtaatagctatgtatgtgcattgtcaaaatatcaaattattgtttcaagtagtattaataatggcgcaacatggtttacttcgttgcaaaatttacacaataaatggactacacctttagctgttgaagggttatatttaggaaatgatcggttacttgatatgggagtgacaccaatatatataaaagatgtattgtctgattattcgttcgatatgatttatgatagaaacaaaaaaattgttgaagatgcagaagtcaatattgatcagatgtcaatatttgaatttataggagaatagaatgaattttgattataaaaaatatccagtgacagccggggtgattggaatatgtattttagtttattgttatacaaccgttaaatacggttttgaaatgaatgcttatcaaggaatcagagcaggtggatttaatccaattttggttttggcaggaaatcaatattggcgattaattagtgcaaactttattcattttggaattatgcatattttttgtaactgttattcattagttaatctaggctcagttatggaatatttgttgggaatgaagcgttatttgattattttgattgcttctgcccttgcaactacgattttaccaacagttttttatattttgactggaaatggtgctagtagtattatgggaggtatttctggagctatttttggattgatgggagctttattagcattggcttggaaatttaaagatgtttatgcatatttattcaagcaaatatcgtcaagtgttctattgatgctgctgatttctatattggtgccttcgatttctttatctggacatatttcaggtatgattggtggttttattgcaactttactaattatcaaatttatgcctttacgcatttggaaaaagaaaaaaccggaaaattatcataatcttgtcaattaataatcagatatagtaaaatataaacatatagaggagagtacaatgaaacaaaaagtaagaaaagcaattattccagcggctggattaggaacaagatttttaccagcaactaaagcactagcaaaggagatgttgccaattgttgataccccaacaattcaatatattatccaagaagcagtggatagtggaattgaagaaattttaattattactaattcaaataaacatgcgatggaaaatcattttgataagtcgtatgaattagaagcgcgtttaacagaatcaggtaaaatggaacaagttaaaatgatacaagatattgctgatatggcaaatatttattatattcgtcaaaaagagccaaagggattaggtcatgcggtattatgtgcaaaatcatttattggtgatgagccatttgcagtattattaggtgatgatattgttgtaaatgatggtggtgagccagcattaaagcaattaatagatgcgtatataaataaagaagcatcagttgttggggtacagacagttgaacataaagatgtttgtaaatatggaattgtcagtccgtcacattcgcatcctcgtgaaaatggtgggcgtttagttaagttaaataatatggtggaaaagccggcagttgaagaagctcctagcgatatggcagtattaggaagatatgttttgacaccaaaagtatttgaattgctagaaactcaaggaaaaggtgctggtggagaaatccagttaacagatgctatcaaacgtttaatggatattcaagcggtctatgcgtatgactttgaagggattcgttatgatgttggtgataagtttggttttattaaggcaacgattgattttgcattaaagcgcgaagatttaaaagaaaaggttcaagcatatataaattcacttgtaaaggatgttaaatgatgagttttcaagagaaatatgaagagtataaacaaagaaaagaagcgcaagcgttttttaatcaaaataatgatcaaaaagtatatgggaaagattatttaatagctattttagttggatttggttcaacgatcgttatgggatgtattttaacctggattatttctaaaataggttttaatttttcatactttactattttaattggaatttttgaagctcaggcaataaaaaaagtattgaataaaagtggtcaacaattagccattattgctgcagttacttttgttttaggaattgtcgtggcacaagcaatttttataagtataacgctacctttttttaatgtcagcatgctagttgaaacattcaaatattgtttccaaaatatgataacaggtgatgtgttaagtacaattatctatttatttggtgcgattgcggcatatatggcattaaaagattaaatatattaatttaaaagaatataattggctgatcggttttagtgatcagcttttttgttatattatttttaataaagattgatggattcaaggtaaatggattgttaaataaaaacattctttttatttaaaatgaaaaaataatgcctttctatatttgtgagggtcttttagtaattataactagcaatacaaaaggctacgtagtataataatggtatgcaaaaggaggatttttaaaaatggctaaaaagtttttatcaatggatggtaatactgctgcagcgcacgttgcgtatgcgtttactgaagtagcaagtatttatccaattacaccttcatctccaatggctgaaaatgcggaagcatggtctgcccaaggtaaaaaaaatatctttggttcacctgttaatgtaattgaaatgcaatcagaagccggagctgctggtgctgtccatggggcgttacaaggtggtgcacttgcaactacttttactgcgtctcaaggtttattattgatgattcctaacttatacaagattgctggggaattattacctggtgtattccatgtatcagcaagagcacttgcaacaagagcattaaatatttttggtgatcatcaagatatttatgcttgtcgccaagttggaatgccaatgatttgttcacactcagttcaagaagtaatggatttaggaggaattgcacatttaacggcaattaaatcatctgttcctgtaatgcacttctttgatgggtttagaacatctcatgaaattcaaaaagtagaagtaatggattatgatgtattagaaagtcttttagataaagaggctcttgctaaatacaagaaaaatgcaatgaatccacacactaacccaattgagcgcggtggggctgaaaatgatgatatttatttccaaggtcgtgaagctcaaaacaagcattatgatgcagtggtagaagtagttgctgattatatgaaaaagatttctgaaattaccggtagagaatatgctccatttacatattatggggcacctgatgcagcaagagtaatcgttgcaatgggatcagtaacagaaacaattaaagaaacaattgatgaaatgaaccgtcgcggtgatcgcgtaggtttaattaaagtacatctatatcgtcctttctctgccaaatacttattaaaagtattacctaatacagtggaaaaagtagctgttctagatcgtactaaagaaatgggtgctactggagagcctttatatttagatgttgttagtgtccttaaagacgttaaacatgtaagagcaattgttggtggacgttatggtatgggttctaaagatactactcctcgtcaaatcaaagcagtatatgatcatttattagaggatgctccatttacttcatttacaattggtattaatgatgatgtaactaatctatcattaaaagaggatcctgaatttaatgttgatgctgattatacagcatgtctattttatggtttaggttcagatggtactgtttcagctaataaatcttcaataaaaatcattggggatcatactgatttatattcacaagcttattttgcttatgattctaaaaaagctggaggggcaacacgctctaatttacgctttgggaatactccaatcagagctacttattatgtaaataatgcggattttatttcttgttcattagacaactatgtaattaaatatgatatgttaaaaaatcttaaagatggtggaacattcttattaaatacagagttctcaaaagaagaaattattgattatttaccaaatcgagtaaaaaaacaattagcagataaaaaggctaaattctatataattaatgccaataaaattgctggcgaaattggtatgggaagaagaactaatacaattcttcaatctgcattctttgcattaaatccccaaatcttaccaattgaaaaagctgttgaatatatgaaagaaatggcaaagaaaacatatagtaaaaaaggtgatgctattgtccaacttaactacaaagcaattgatgcaggtaaagacgcaattgaagaagtagctgttgataattcttggtctgatttaacagtaactgcaactagaagtactactggagatgaacattttgatgaatttgtttcagtaatcaatagtttagatggttatgatttacctgtttctgctttcatggataaattagatggttcaatgaaatcaggagtggcaatcaaagaaaagcgtgcaattgcaactgaagttcctcgttggaataaagataactgtattcaatgtaataactgtgtaatggtttgccctcatgcaacgatcagagcgttcttgcttgatgaagaagaaatggctaatttaccagaaaacattggtgatgatgttttagttccaatgggtaaagatatgggtggattagtatatcgtatccaagtttcaccggataactgtgttggatgtggtttatgtgttactgaatgtccaggtaagaaaggtgaaaaagctcttgaaatggttagtgtgaaagatgaattagtacatgctccattagctgattacatgtatgctaatgttaaatatcgtgatgataagtatccattaactacagctaaaggtgttggtttcatgagaccgtattttgaagtttcaggtgcttgtggtggatgtggtgaaacaccatactatcgtttggcttcacaattatttggtaaggatatgatgattgctaatgctactggatgtagttcaatttatagtggttctactccttctacaccttgtgcgattgatggaaatggtcaaggaccagcatgggctaactcattattcgaagataatgctgaatttggtttcggaatgaaattagctgaaaattataaagttgggcatctattacgtattattgaagaaaataaagatgcttgtgaaccggaactgaaggctttattggaagagtatgttgaaatcaatggtgatcgcgctaaagaaagagagcttgtgcctcaaatcatgactgcggttaaagcttcaagcaacgaagcaattaaagaattgttaaatcatgaaggagatatggtaagtaaatctcaatggatcattggtggtgatggatgggcttatgatatcggctatggtggattagatcatgttattgcaagtaaccaaaatgttaatattttagtacttgatactgaagtatattctaatacaggcggacaatcttctaaatcatctcaagctggatcaatcgccaaatttactgctgggggtaaatcagctgctaaaaaagatttagcacaaatcgctatggcatatggacatgtttatgttgctcaagttgctatgggagcaaatcctgtacaaacaattaaagcattcaaagaagctgaagcttataatggaccttctttaatcattgcttactctccatgtatggaacatggtattaaaggtggtcttgcaaatcatcaaagacaacaaaaagatgctgtatcttgtggatacttcaacttattgagatatgatcctcgtcttgaagatgcaggaaagaatcctttgcaagttgattctaaagcaccagactttgataaatttaaagatttcttgttatctgaaaaccgttttgcacaattgttaaaggttaatccagaacatgcggaggcattaatggagaaatgtttagctgatgctaaaaaacgtcgtttaagattagatagaatggcataaaaagtttaaatcagaggaaaaatcctctgattttttcttattcgactgcaaatatagttgattattacactgttttttggaaacttaataaaaaaataaaaaaaatgtataaaattctttacaagagcaaatattagtgatagaataatcatgcactcgagataagagtggagatcattgaaaactaaacagaattaagaaacacacgtcaatatccagaaggataaaaaagaaaaaagagctaaacaaacgaagagttgtttaaataaacaatggagagtttgatcctggctcaggatgaacgctggcggcgtgcctaatacatgcaagtcgaacgcgagcacttgtgctcgagtggcgaacgggtgagtaatacataagtaacctgccctagacagggggataactattggaaacgatagctaagaccgcataggtacggacactgcatggtgaccgtattaaaagtgcctcaaagcactggtagaggatggacttatggcgcattagctggttggcggggtaacggcccaccaaggcgacgatgcgtagccgacctgagagggtgaccggccacactgggactgagacacggcccagactcctacgggaggcagcagtagggaattttcggcaatgggggaaaccctgaccgagcaacgccgcgtgaaggaagaaggttttcggattgtaaacttctgttataaaggaagaacggcggctacaggaaatggtagccgagtgacggtactttattagaaagccacggctaactacgtgccagcagccgcggtaatacgtaggtggcaagcgttatccggaattattgggcgtaaagagggagcaggcggcagcaagggtctgtggtgaaagcctgaagcttaacttcagtaagccatagaaaccaggcagctagagtgcaggagaggatcgtggaattccatgtgtagcggtgaaatgcgtagatatatggaggaacaccagtggcgaaggcgacgatctggcctgcaactgacgctcagtcccgaaagcgtggggagcaaataggattagataccctagtagtccacgccgtaaacgatgagtactaagtgttggatgtcaaagttcagtgctgcagttaacgcaataagtactccgcctgagtagtacgttcgcaagaatgaaactcaaaggaattgacgggggcccgcacaagcggtggagcatgtggtttaattcgaagcaacgcgaagaaccttaccaggtcttgacatactcataaaggctccagagatggagagatagctatatgagatacaggtggtgcatggttgtcgtcagctcgtgtcgtgagatgttgggttaagtcccgcaacgagcgcaacccttatcgttagttaccatcattaagttggggactctagcgagactgccagtgacaagctggaggaaggcggggatgacgtcaaatcatcatgccccttatgacctgggctacacacgtgctacaatggatggtgcagagggaagcgaagccgcgaggtgaagcaaaacccataaaaccattctcagttcggattgtagtctgcaactcgactacatgaagttggaatcgctagtaatcgcgaatcagcatgtcgcggtgaatacgttctcgggccttgtacacaccgcccgtcacaccacgagagttgataacacccgaagccggtggcctaaccgcaaggaaggagctgtctaaggtgggattgatgattggggtgaagtcgtaacaaggtatccctacgggaacgtggggatggatcacctcctttctaaggagaaacgcatgatcgaagatgatgcacaagagaagtgatgtttcgaagatactgtttagttttgagtgatactcaggtatgactcagagatcattgaaaactggataatagaaaataaattgcgatagaaatagaaaatgagatcgaaatagtaattgttattattgaggtctttctagaaaagtcgaaaactaagaattttcatcactaaaaaacataaatcgaaacggatggatggattttagtaaatagttgaaaatagtaatcaagcaaacaccaaaataggtaaagtaagaaagagcgtatggcggatgcctaggcacagagaggcgaagaaggacgcagcaaacagcgaaatgcgacggttagcagtaagcatgcaacgatccgtcgatgtccgaatgggggaacccacctggagtagagaccaggtatcctgaagtgaataaatagcttcagagaggcgagactcagggaactgaaacatctaagtacctgaaggaagagaaaataaacgaatgattccctaagtagcggcgagcgaaaggggaagagcccaaaccgatcttaggatcggggttgtaggactgtcggcaaagagcaagaaatcattataggcgaacggaatgggaagtccggcgaaacagggtgacagccccgtagccgaaatagtgaagaagcacgagacagcacctgagtacggcgggacacgaggaatcctgtcggaatccaccaggaccatctggtaaggctaaatactcctctgtgaccgatagtgaaccagtaccgtgagggaaaggtgaaaagaaccccgggaggggagtgaaatagaacctgaaaccatatgcttacaagaagttagagcccgttaaagggtgatagcgtgccttttgtagaatgaaccggcgagttacgatatggagcgaggttaagcaggatatgcggagccgaagcgaaagcgagtcttaacagggcgaaagttgcatgtcgtagacccgaaaccgagtgatctagccatgaccaggttgaagttggggtaaaacccgatggaggaccgaaccgacccccgttgaaacgttggcggatgagttgtggctaggggtgaaattccaatcgaactcggagatagctggttctccccgaaatagctttagggctagcgtcgaggtaaagtcgtgtgaaggtagagcactgaatatgtgatggccccatctcggggtactgaacataatcaaactccgaatgtcacaaagatatactcggcagtcagacagtgggtgataaggtccattgtcaaaagggaaacagcccagaccatcagctaaggtcccaaaatatatactaagtggaaaaggatgtggagatgtccagacaactaggaggttggctcagaagcagccatcctttaaagagtgcgtaacagctcactagtcgaatgactctgcgccgataatttaccggggctaagtatattaccgaagctatggatttacgcgtaagcgtgagtggtaggggagcgttctatgtgcggagaagcggtaccgtaaggagccgtggagcgcatagaagagagaatgccggtgtgagtagcgaaacgtgggtgagaatcccacgcaccgaaaacccaaggtttccagaggaaggttcgtccgctctgggtaagtcgggacctaaggcgaggccgagaggcgtagtcgatggacaacaggtagagattcctgtacttacggtatgaatgatggagtgacggagaaggctagcggatcctgctgatggaaatgcaggtgcaagcgaggtagccgacagccaggcaaatccggctgtcgaaaggcaaaggcgtgaggcgtatggaaagctgcggcaagtacagaagtccgtgaagccagcttccaagaaaagcttctagtgataatcatacagtaacccgtaccgaaaatggacacacatgggtgaggagagaatcctaaggtgagcgagagaactatagctaaggaactctgcaaaatgactccgtaacttagggataaggagtgctcatagagatatgagccgcagtgaaacggcccaagcgactgtttaccaaaaacacagctctatgctaagtcgaaagacgacgtatatggggtgacgcctgcccggtgctggaaggttaagaggatgtgtcagcgcaagcgaagcattgaattgaagccccagtaaacggcggccgtaactataacggtcctaaggtagcgaaattccttgtcaggtaagttctgacccgcacgaaaggcgtaacgatttgggcgctgtctcagctgtagactcggtgaagtcttagtacctgtgaagatgcaggttacccgcgactagacggaaagaccccatggagctttactgtagcttgatattggactttgatgcaagatgtacaggataggtaggagactgagagacatgcacgccagtgtgtgaggagtcaatgttgggatactactcttcttgtattggagttctaaccggatgccatggaactggcaacgggacagtgtcaggtgggcagtttgactggggcggtcgcctcccaaagagtaacggaggcgcccaaagataccctcagcttggatggaaatcaagcgcagagtgcaaaggcataagggtgtttgactgcgagacctacaagtcgagcagggacgaaagtcgggcttagtgatccggcggtgctgaatggaaaggccgtcgctcaacggataaaagctaccctggggataacaggctgatctcccccaagagttcacatcgacggggaggtttggcacctcgatgtcggctcatcgcatcctggagctgaagtcggttccaagggttgggctgttcgcccattaaagcggtacgcgagctgggttcagaacgtcgtgagacagttcggtccctatctgtcgtgggcgtaggaagtttgagaagatctgtcctcagtacgagaggaccgggatggacatatcaatggtgcaccagttgtcacgccagtggcacagctgggtagctaaatatggaagggataaacgctgaaggcatctaagtgtgaaacccacttcaagatgagacttcccattacgcaagtaagtaagaccccttaaagacgataaggttgataggtcaggagtgtaagcatggcgacatgttcagcggactgatactaataggtcgaggacttaacctagagaaaaagggttaaggcttgaaactgaaagaagacaaagtggaagacaaaagacgcaagaaaactattatctagttttgagtgattctcgaaaggaattgcttagaaaagaagatctggtagcgatagcatgatggacacacctgttcccataccgaacacagaagttaagcatcataacggcgaagatagtaccaaggtgcgacaatagcaagctgccggttctttttttatttacggatacctctgcgtatccttttttctttgttctaaaccgaagtatgccttacttataatcctttaaattaggactactttgtagtataatagatatggtgataaaatgaaaattaaattatattttggacaagaagatgctatcaaaaaatcaggaattggtcgtgcttttgtccatcaaaaaaaagcattagaattatcaggaatcccttatactacagataaggatgatttggattatgatattctccacattaatactgtatggcctgatagttttaagataataaatcaagcacgaaagtataataaaaagattgtatatcatgctcatagcacagaagaagattttaaaaattcttttatgttttctaatactgtttcaggggtttataaaaaatggctgatcagtatgtatacaaaaggtgattatattgtaactccgactccttattcaaagcggattttagaatcttatggaattacacttccaattaaagcagtttcgaatggtgttgatttgacacagtttaatcctagtcaagaacaaattgaatcgtttattcagcaatacaaaattgattctaaagatgttgttattatttcggtaggttggctatttgaaagaaaaggatttgatacttttgtatcggtggcaaagaaattgcctgagtataaatttatgtggtttggtgatattaaattatcacgtcctacaaaaaagattaaagatttactagatgatttacctcaaaatgttattttaccaggctatgttagcggtgatataattaaaggggcttatggaagaagtaatatattctttttcccatcaagagaagaaactgagggaatagttgtattggaagctttggcaagtaaatgtaatgttttactgcgtgatattcctgttttttcagattggttagaaaatggcgtgaactgttacaaaggtaaccacacagatgattttgttgaaatcattaaaaagatgattaacggagaatatccttcattagttgcgcaaggctataaagtagctaaagagagagaactatcaaagatagggaaagaattattagaggtgtatgaagaaacgctgaacctctaatatgaggaaagcttatggataagaaatctaataaaaaatatttccttaatattattttaattcttgttttaggggcaactgtaatttattttacaatgaaagatgatttacatgcttctttaagagcattaacaacggcctcgcctttatggattgttatttcctttgcattaatgtctatatattttttattagatggaattaatctatatacttttggtaagttatataaaaaggattatagttataagcaagggtttgtaaattcgatttcaggaactttttttaatggggttacccccttttctagtgggggtcaatttgcacaagtctatatttttaataagcagggaattgccccaactaactctgctagtattttattgatggcttttattgtttaccagtcagtactagttttatttactgcagtagtgatgattttccgttatcaggcttatagttcaatgtattcagaatttttttcattagcaattttaggcttcttgattaatttctttgttattactggactatttttaggtgctaaatcaaagcgattacaagattttatttgtaataatattgtaaaagcgttaagtaaaataagaattgtaaaaaactatgaagatacttctattaaaattgcacgttcacttgaaaactttagaacagagttaaacgtgttattaaaaaataagaatgtattgataaaatcatcattaattaatttgtttaaattattaattatgtatagtattcccttctttgcagcaaaagcattaaaccttaatgtttcatttatccaaatattcgattttattggtatttgttcatttgtttatatgattactgcctttgttccgattcctggagcaagtggcgggagcgaaggagtttattatatgttatttagccctattttaggggctgttggtacgccaacaacattattagtatggcgctttgtaacctactatttaggactaattattggtggtatcatttttgcaactaatcgagaaataaatagatcggagtaaagtaatgagaatagcaattttttcagatacatatatccctgatattaatggggtagcgacatcaactaaaatattgaaagatgaattagtaaaacatggacatgatgtagttgttgttactagcgagttacctagtgatagtgattatatggatgatcctcatgataatatcttaagagttcctggattggaaatacaagccctgtatggttaccgggcttgtaatatttattccttcaaaggaatgcgtgaaattaagggaatgaacattgaagttatccacgttcaaactgaatttggggtaggaatatttggaagaatcgtaggagaaactcttaatattcctgttgtctatacgtatcatacgatgtgggcagattattctcattatgttaatcctgtaaattctggagctattgatggtttgatcaaaaaggcaattacacgtattagtaaattttatggtgataaaagtactgaattaatcgtaccttctttaaagactaaagaagcattagaattatatggtttaaataaagacgtccatattattcctacaggattagaactagaaaaatttgatcctaaaaataaaaatactgaattgattgagcaaattaaagacaaatatggaattaaagatcagtttattgtaacttttttaggacgaattgcgaaagaaaaaagtattgaagtattaattgatgcaatgaaggaagttattaaagaaaatgataatgtactttgcttgattgttggtggaggaccacagttagaggaattgaaagaattagtaaaagatgatcatatcagcaattatgtgatttttaccggccctaagcctagtaatgaggtaccaagttattatcatttatcaaatgtatttgtttctgcttcaataactgaaactcaaggattgacttatattgaggcgatggcaagtggaatacctgctgttgcacgctatgataaaaatttggaggatgttatcgatgacggtgtaaatgggtacttttttaaagaaacatcggaactagtggaaatcctactaaaattaattaatcataattattctaaaatggcagaagccgcatacttaagtgcaatgaagtttagtagtgaagtattttatgaaaaggtaattgctgtttatcagcaagcaattaattcgaaacactattcatatacggtcaagtcgatatatccggttaaaagagggataaatgaagttgtttttctatttgatgaaagtgagattattgttgaggtaaatgataaattaattaaagcttatcaattagagccaaataaagttattgataaagagttatttgatgttttaaaagattttgaacaagtttctcgggcctataataaagcgttaaaattactcacagtaaaagattatacttataatcaaatgaaaaagaagttaatggatagtggtgattatgatgatacacagttagatgcaacgctagagttacttcaagagaagaatttaatgaatgatgaagcatataccttaaattatttaaaacgctgtacacgacttggaattggcttaaataaagctatttataatttacggagttatggaattgatagtcaaattattgatcgatgtttagaagagattgatgatgatgacgatgagtataatgctgccaccacattaattgaatccatttatagtcgtaatactagtttttcttataaagcaatggtgaagaaaattcgagataaactttatataaaaggctttacttctgaaacaattgaacgagcacttagtgattttgattttgagtttgatgatcagcaagaacaagaagctttggaaaaagaattctcaagacaaaagaaaaagtattcaaaaagatatcaaggtactcatttaaaagaaaaaatcattgatactcttttaagaaaaggttacaattatgagcatattaaagaattattaaatagagaaggagccttggatgatgaataaaataaatgaattaaaacctggtgatgaaggcgtagtaattgaggcactgattaaccgtgttgttgttggaaaaacaaatggggccaatcgttctacctatcttagtattactttacaagatgctactgggacaatcgatgctaaattgtggaatgcaactaatgagcaagtagaaaagttagttatgggttgtgttgtacaagtaaaaggtgatgtaatcaaatataatgaagatcgccaaatgaagataatcaaaattgttgttgcttcaactgaacctcaagaacaagttaaatttctaaaaagtgcgccacaaacaggagaagagcttgtaaaggagatttatacttttattgagcgaattaacaatcttaagttaaatcagttagttaaagcattattcaacgaacatgttgaaaaattaacaatttatcctgctgctagcaaaaatcatcatgagtatgtatctggattagcatatcatacttgcagcatgttaaggatagctgatgctttggctcgattatatccatcattaaatagagatttgttatttgcgggaattacattacatgatttaggtaaaacagtagaactaagtggtccagttgtacctgaatatacaatcgagggtaaattattgggtcatatatcaatctctcaggcaatgatcaaagaaatggctgataaaatgaatattgagggtgaagaagttacgctgttacaacatataattttatctcatcatggaaaaaacgaatttggttcaccaatactgccacaaatcaaagaagcagaggtaatttatttaattgataatatggatgctcggatcaatatgctagataaagctttagagacagtagaaccaggtggtttttcaaaacgagtttttgctttagaaaatagagccttttataaaccaaaaatgaattaaattaagattgtaaaacttattaaaaagagtaattctatcatttgacagaattactctttttctgtgtgccgagcatggcatacatttagctggtgaaagtcccaccacgggtatttaccgctaagagtagtgaaccacaaaccattagtagtgatgctatgggtgatggaattggtgtagcgaaatattcgagattacgaaaagaaatttgatgaggctgaatgggagataaggttgcagaacaaaccaagacagtaaatcaaaaacctgtgaagataagaaaagatgtatgccttacctcgggagaccttgtggacgatgaagtccagtaaactgttaaaaacagtaatgataccatcgatagaaaaagatttatcacaagaagtctgatgaagtcatagtagtcagaaatgatgaaggactgaaacgtttatagagtgcaaatcactataagcaatatttggatagttcgaaagtaaggatagcctagaactgggaaacgtaatcctagatggtaaaagtaaagagaatttgaaaatgactatcgaaaaggtcaaacaaaataaaggagtacctggaatagacaaaatgactgtgcaagaggtggaagaagccaaaggcaatatatagaaatctaatgaaattaaacaaggcatgtaaatgtagatttagtgaagatgacatttataagtgtgcaaacacaaggttaggctggtataggagaagtggaatgaatatagtcaattttataatatcgctaaaagttctaagcataaagaaaggtgatagaccaggtttagtctatcacctagattattatcttaagagtgatataaatgtagagccgtatacgagacatgtacgtacggttcaatgggagaataaattatcaaatttattcctttaccctattaatgaaatagaagtataaataacaatttaattatttaaatttaagaatttttacgatcactttaaaaccaattagcagtttcagaagtatgataatgtatttgcaattcggaaatgtgataacttaacacattattattaaaaagtggttcatgtttataaaattcttgtatttcagtttcatttctagattttattacagttattgaagaactcatatcgctttttaatgacgaaaagagtactttccccgctttcattaaaagatttgtatatttttgatgctcttgcatcatttcatttgtcattcgttcaggatgagtaacgataccttcgattaaaaaatacttcatagttttaacttcctccaaagtcaataattttaaataaattataacatttagattaagtatcgtcatttttttaacttttataattacagataggataatcaatttaaaatgattttgataaaaaaacgctaaataagtaatatacaagagtaaattactttaatttagcgaaaatatctaagttttataagctgtttattttattaaaaatattatctaaatcaacttcttgactacgatcagtaaagtcgattttgatttgatctgtttcattatatcttggaataatatggatatgaaaatgcataacagtttgaccagccacttcatttgcattggtaagcacattcgcgccttttgcgtctaaattagtgattatttggttagtaagcttttttgttactttgattagatggctcaaaacttctttatcaacatctaaaatattttgatagtgtgttttaggaacaactaatgtatgtccgttagttgtttgactcaaatctaaaaaagctagacataaatcatcttcatatacaattttaccaggtatttctttattagcgattttacaaaagatacaattctccatttctataagtcctccataatattattctaacatagaaaaaagataaggggaaaccccttatccgaaataatcttcatttgattctttaatttcatctttgattgctgattcgtatacatcaaaattgtatttctttaaataatatgtttccatttttgtagacatatcactaacagaagctaaattagtaataatttcatcttttagatcttttttatctgtattgtaaacataaactacagcatatttagattcagatgtcttaatcactttattataaataccatctttagtaaatttatctaattttttaataatttttgagtcgacactgcttgttttagtagtgaccataccagcatcagtaccattgttttcagtcattaaagtgtcaaaatcactgccatctttaactttatcaattaaacttaaggcagctgattcagtgtctaaagtaataatttttaaatatttaactttgtattctttaaccaggtcatcatagttatctttaatatatttttctttaagcatggtttgttttactcctaaagttaaaacaccatcgatatattcttgttcagtttcataaccatattgtttagcatattcttctaatgaagtagttaagttttcagtaaaacttgcaaccttttcattaattctagtttgcactgcatccttgtctgtcagttcttgatcagcaatataagttaaagctaatgaaagaacttcagaacttccatattcttttagtaaataatggtaaacatcatttttactaattttaacatcatcagcagttgcaatagtcttatctccatcttttatttctgaagtataagtagttgcactagaagaactacatccgaccaaaagagttgcaactattgctaaaggaaatatttttttcttcattagtttgttcctcctcggctagtttcgcgttcttttaaagcttcatcaattacattattaattattttttcagtatttttatcatcgtatttaacattataagattgataaacaatatagctcatatacttatcatatgcaatcaatggagtatcaatagataaatctttttttatttctttttttatactatctttatcagtactagtaacttttacaaaataatatccatcagtaccttttatggcttcactagtttcaccactggcaagtgctaatattttagtttcaacatcactaccaaatgtttgtgaaagaccacttgtagtatctacaatacctaattttcctttattcttgttagtgtttgtatcatcagagtaatctttggcgatatctccaaaacttttacttgagcttaataaagcagtgacttcactcaattttgctgtttcatcagctgttggattttcaacatcagtcattgaaactttaataagactagcttcacgtggacttgcttgagtgtaataatcatcgaaaacttcatcaaagttcttttcaacgtaagctaataaaaagttgcatctttgatagactctcaccatgttttcacgatattcatcaagtgaattaaatccacttgaacttaacgctgtttgtaattgagtttcagcattatcgccatattgattttcatagtaagtttggatttgatcaactgtttcattagcatcagtttccatatcctcatcgattgggaatttttgatccattaattgttgaagcacggcattaaagtatgaactttttccactggcagtagatattacatcgttaaaaatatcatccgcaaaaatatttttatcttttttcccactgtttaaagaagcaactacatatttcccatcttctttaactgttttcgagctgttttgacaaccagttaataagaaactagtcacgactagtgccgcagcacatttacctaatttcatatctttcctccttatctttccataacgttacaattatactatttatcgcatctaatttcaataaattaggcaaaaacacattgccaattgttattttaacataatttataatatgtaggtggtaggaggggatttgatgaataactgtaaatgcactaatgtaaacatctatgtcttgtttattattctagttattgtaggtatctattgtatgtaataaaaaggaggcgattacaatggcatgccaagataattcttttacattgatcttagttttattcattttattagtaatcatttgtaatatgtgctaattaaaaaaggatgtcgccaagacatccttttaaatataaaaaactattgcaataaaatgtaagatagaagctattgaaataaatatatgccagattacatggttgtagggtatttttttatttgcataaaagtatgctccgattgaatacattaaaccaccgataacaattagccagagaaaagcagcactagaattttgaatgattgaaggcataaataggatggctgtccatcccataactagatagatagttagcgaaagctttggtaaactttttattgaaatagatttatataaaattcctactattaccattgcccattgaataacaaggatgatgattccctgatatcctttaattaaacacagagcaactggggtataacttccagcgattgcaaaatatataaagatatgatcaaggattctgaatacctgtttatgaggactgtcatgatccatagcatgatatagagttgaaacaagaaacattaaaaaaatgcaaattgtaaaaacactaactccaaaagattggataggaccacctttaacatatgcatatacagcacaagctgggattagaagtaacatgataaatgccataattccatgagttatacaattaaataactcttctttaaaatatggcggaaagattctttttattttttttgtaattttattattcactttttccaattttatcacccagtacatactataatataaattacttttaaattcaaacaaaaatgatacgctgctgcgtatcattccataagcttttcattttgatgattttctttataaacttgaaaagttattttagcacttactaatagtggcatagcgattaccattccccaaataccgaagagagaagaaccagagagaatcccaaaaagtacccacattatactcaaatcaattctagatgaatagatacgtggagtaatcacatatgacataatcgtcgattgaatgaaaatcaaaataaataaaataacaattgtagtagttcccattcctaacgaagtaattaatcctaaacaattcgcaacgattgggccaacatatggaataatggagctggctcctgaaacaaacccaagaattaaccagttaggatgaccaattgctagatacatcagcattgttgtaattgcttgagcgattgctccaataaagaaagctttaacatattgtactaaagaagaatcaatttcacgtaaatagattggcaatgttttatcaatacgatatgtaatattacgaatatgactacggatatttttaaaattactagacatataaattgctagaatgatgtagattaaaaaattagtgacattgatcataacttgatttaaaacatctatagttgtatctaaaacaactgaatctttaaagaaagcattgacaatattctgaatatggcgcattaaagaagaaatatcataattgaaattttccttaacaaacacaccaatttcaccaagtcctgagtaaaaagccgggaacatttcagagatactttcataaatcattggtacagctaaagaaattaataaagttaaaatagcaaaagcagctaagtagaccattgttacggcaatgcttcgtttagtaacatacttttcaatataatttatcagtggatttaaaacaaaggcaattgtaaatccgacaataaatggtttagaaaccagccagatcgctgataacaccccataccataaatcaccagtggcaataattaatagtaatattactaaaacgatcatcacatttaataaagtatgggtgattttttttgatgaaataattttaaataatgcttttagaaattccatttttacacccccattacatataaatataccacaatttactaataatataaattgaattgaatttctattttagaaaaatcaaaaatagttaaaatgtataaagttttataattttcatctaaaaaaagcaattggatgttatgattagaatattataatagagcaaatctcttgataattatcgataatttggtcacaatgtggttataatataaattgtgctagattttgattggaaaatagtaaaaatttttgctataatttatcattttatttgttttttgataacttatctagtagaattagtaaggatagaaaggggcttaattatgtcaactttaaaaatagaaaatttgcatgtcagtattggagaaaaagaaatcttaaaaggtatcgatcttgttgttaatactggtgaaacccatgcgattatggggccaaatggtaatggaaaatcaacattattatcagttatcatggggcatcctaaatatatagttactcaaggtagtatctacatagatgatcaaaatgttttagaaatgagtgttgatgaaagaagtagggcaggaatctttttaggaatgcagtatcctcaagaaattccgggtgttacaacttcagattttttaagagctgcattaaatgcacatcaagaaaaaccagtatctttatttaaatttgtaaaagcactggataaaaatattgctgatttgaaaatggatgagaatttagcacatcgttatctaaatgaaggcttctctggtggagaaaagaaacgtaatgagattctacaaatgaaattattacaacctaagtttgctctattagatgaaattgattcaggtttggacgttgatgcgttaaaaatagtatcacaagcaattaacgctatgaaatcagatgattttggatgtattatggtttctcactatgaacggttgtttgaattggtgccaccaagtcacgttcatgtattagttaatggtaaaattattttaagtggtggaattgaagtagtagaaaaaattgatcaagaaggctatgactgggtaaaagaattaggagttgaaatcgctactgatgaaaagaaaccgattttacttgaaagttgtgccaataaagaaagaatgaaagctaaataatgaaacagttaaaagagattaaaaattatttagtatttcataatggtacaattgaatgtcacccagaaaatgtaggaattgctattaatgatggtaaaatcgatgttaaagatgctgcctcattacaaattatttatctaattgatcaagaaggaaaatattgttttgacctaaagattaaaggacaactggaattaattgagacttatgattttaaagttccagcatctttagttaaaaacattgaagtattgcaaaatagtaatattttaagatataacgataatcaaagcagtgtcaacgggactgttgaagtaactgaaaatgtatcggttgagcgtgatagtaatgtaagatgcgcttatgttgagttatcagattcaagtattgaaatgaatgttaatcatgctttgaatggttttaacgctaatagtacggtgcgcttagcttcattagctaaaggacaggaaaagaagcatatgacattttcgttaacgcattttgcaccacatacaaccgggattatggataattatggtgttgttaaggatgcatctaatttagttatcgatgggattggaacaattaaacaaggaaatcatcaatctagcagtcatcaaacaaataaaattattgtttttgatgagaaatgtaatgccaaggcaaatccatatttatatattgatgaatatgatgtaaaagcaagtcatggtgctagtgtcggtaagattgatgaggatcatttgtattatctccaatctcgtggtttaagtaaaaaagatgcaatgcatttagtaacttatggatattttattccagtcatggaatttatagataatgctgatttaagagagatgtttaacgaaacattaaaagaaaaggtggggatttaatgttagatgtagaaaaaattcgtcaggattttcccatgttaaatggtgctacgatgcatggtcaaccactgatttattttgataatggcgctacaactttaaagcctcagtgtgtaattgatgctgtatgtaattatttgacaaactattcgggtaatgcacatcgtggtgactatgacttatcgcatgatgttgatacacagttcgaaaagacacgtgatttagttgcaaaattaataaattgcgatcgaaaagaagtagtttatacatatggttcaacagacgggctaaatatgatagcatttggctatgggatgacgcatctagatgaaggtgatgaaatacttttaaccgttgctgagcatgcctcaaatactttaccatggtttgaagtctgtgatacggtgggaagtacggttaaatatattgatttagatgatgaaggacgtcttactgttgttaatgttttaaaagcaattagtgataaaacaaaaattatttcaatagctcaagtttcaaatgttcttggatttgatggaccaattaaagaaatttgtcaaattgctcatgagcgcggtattatcgtttgtgttgatggtgcgcaaagtattcctcatgaaaaggttgacgtccaaacattagatattgattttctagttttttctggacataaaatgtgcggaccaactggggtgggaattctttatggtaaatatgatttattacaagaaacaaaaccaactcgttggggtggtggaagcaatgcccgatataagagctgtggaaggattaaattaaaaaatgcaccggctaagtttgaggctggaacacctaatattgagggtgtcattggtttaggtgccgcaattgaatatttaatagaaattgggatggacaatattcgtgattatgaattagaattacgtcaatatgcggttaaaaaaatgttagaattagataatttggaagtttataatccaaatggtcatggagcgattgcttttaatatcaaaggtgtttttagtcaggacggagcttcactatttaacacatatggtattgcaataagagctgggcaacattgtgctaagattcttgatgaatttttagatgttagtcaaactcttagagcatcattctatttctataatacatttgaagaaattgacagatttattgaggtatgtaagaaaggagatgactttttagatgccttctttggatagtatgatgttacgacaaataattatggatcactatgaaaatccacgtaatcatggactagtagatgatgataattatcagtcagtaaatatggattcagaaacttgtattgacgatattgatgtgcaagccttaattgaagatggtgttattaaagatatccgttttgatggcgaagcatgtgcaatttgtactgctagtacgtcaattatgagtgaattattgattggtaaaacaattgatgaagctaatgttattattgaaaattacaataatatgatttatgaaaaggattatgaccctgaaattttggaagaagcaattgcgtttatgaatactcataaacaggctaatcgtattaagtgtgctactttaggatggacaggaatcaaacagatcctcgataaagaataggaggaaacatatggcagatataaaaaatgaaattcctgatcaggaatatgcctatggttttaatgatggtgatgtttcagttttcaagactcctaaaggaataaatgaagaaattgttactgaaatatcaaaaattaagaatgaaccagaatggatgcttgaatatcgtctaaaatcttatcgctgctttatggaaaagcctatgccaacttggggcgttaatttagaccgtattgattttgatgaatatacttattacgttcgtcctagtgataaacaaacgaataaatgggaagaagtacctgaaacaattaaacaaacatttaataaattaggtattcctgaagcagaacaaaagtatttatcgggagttagtactcagtatgaatcagaagttgtttatcataacatgttaaaggaagttactgaaaaaggtgttattttcctagatatcgatagtggtttacgtgagtacccggaaatatttagaaaatattttgatactgttattccttataatgacaataaattttcagctttaaatggagctgtttggtctgggggatcttttatttatgtaccgccaggagtgaaattagataagccactacaatcttatttcagaatcaattctgagcaaatggcacaatttgaaagaactttaatcattgttgataaaggagcggatatccactatgttgaagggtgtactgcaccaagttattctcgtgattctcttcatgctggggttgttgaaattattgtgggtgaaggagcaaaatgccgttatacaacgattcaaaactggtctaacaacattttgaatttagtaactcagcgagcaaaagtatttaaaaatgggtcaatggaatgggtcgatggaaatattggtagtgctgtaactatgaagtatccaacttgtgtgttgatggaagagggagcaaaaggttcttgtattactattgctgtagctggtgagaatcagattatggattcaggttcaaagatgattcacttagcgcctaatacatcaagtagtattgtttctaaatcagtttctcgccgcggtggaaaagtcaattaccggggaatggtacagcatggtgctaaagcttataattcaaaaagcaaggttgaatgtgatacgttgattttagatgacatttcaactagtgatacagttccggttaattggatgcgaaataatgattctattattgagcatgaggcgactgtctcaaaaatttctgaagaacagcttttctatttaatgtctcgtggtttaacaaaaaaagaagcaatggaaatgattgtaatggggttcattgagccgtttgctcgcgaattaccaatggaatatgctgttgaactaaatcaattaattaaattggattttggggatcagggtattggataaaaaagtattacggaaacaattgattcaagcaagattagatttagatagcgaaacttatgcatctaaatctaattttattgtttctaaattaaaacagcaacctgaatttattgaggcaagagcaattggaatctatgtttcttttagacatgaagtagaaacaatcagtttgattaaggaaataattaataataaaattgtctgtgttccaaaaattagtggtaaacagatggatttttatcaaattaattcaatcaatgaattaaagacaagtaattttggaattttagaacctaataatagtcatcctgttactaaagataatcttgatttactaattgtaccaatggttggctacgatcaaagtggtaatcgattaggttatggcggtggttattatgaccgctatttaagtgattattgtggtaatgtaattggcttggcatttagtttccaagaagttgcaaatttaccagtagaaccatttgatttgccgattaaaaagattattaatgaaaaataatcacggttttgttataatggggaatataaagtagggtgaaattatgtcaagagagaaaacattagttaaaaatacgttaattatggcgttggggacttttctgcctcggattattaatttattgactacgccaattattactagtgcaactactgatgcgcagtatgggcaattagatttagttacaacgacgattctttcatttattgtacctttatgtacgttgcaaattgaacaggctctatttagatttcttgttgatgctaaaagtgaaaaagaacaacggcgtgtcattactaacggatatgtaatgatttttggacttatggtgattgctgcgattatttgtctgtttgtgccaatcagcatgtttgaaggcagttttaagctattgattattggatatatatggattgagattattgcaacaacttctaggtttgttttaagggctttttccaaatataaagagtactctattttggcggcgttagttgtaatagtcaactttgttgttgtctcagtttgtttattgtggctaaagacagggtatattggggttttaatagcattagtagctgctgatgtagtcggctttatttatgtactatgcgtatgtaatatttttaaattttttaattttaaatattttagtagcgaatatgctcttaaaatgcttggctatgcattaccgtttgtacctaatatggtatcatggtatattaatcaattgtctgatcgatggattatttcaatttttctaggggcagggccaaatggagtttatgccttggctaataaaataccttcgattgttaatatcttatatccggcctttaatttagcttggacagattcggcaacaaggagtgtaaatgatcctgatagtggcaggtattataataggatgtttcggatgttgttttgcattgtctcagcaggttcagttttattagtggctggatcaccgatcatctttggaattttatgccgtaataaagaattatatagtgctttcgattataccccaaccttaattttagctacatatttttattgcttctcacaattttttggaagtatttatgtagctgttaaaagtgctaaaaatatgtcggtaacaacgactattgcagctataatcaatattatcatcaatttaggtttgattaatattattggagtacaggcagctgttctttcaacattggctgcgaatttatttttagcgggatatcggttctttgatttgaatcggcgctatgtacgtttaaaaataaataaacgtctaacagtgttgacaatcgtaatttttataattagtatgtctttagcatggtcgggagataaaattttatggatattaaatattgttattgcgcttggctacgcatactttatttctggtgatatttttattggaatgtttaaagctgttttaaagaaacgttaatagtaataatgttaagatttaattatttagcaaagtaattaaattttaacattttttttatgtccttttttgtatagttaatattaatgaattgggttacaggaggataatatggaagcatatcaaaaatcgtttaaagaggtccagcaagcactaggagtcagtgataatggattaagtcaaaaagatgtaattaagcgtcaaacacgatatggaagaaatgaaattattggtgaaaagcgtcaaagtgtttggggaatcttatttgatcagtttaaagatttattagtaataatcttgatttgtgcgggtattatttcagctattagcggagaatttgaaagtacattggtcatcttggttgtaattactttaaatgcattgctaggaacatttcaaactgtaaaagcacagaaatctttggatagtttaaaaaaattatctatgccaaaaataaaggtgttgcgtgaaggtaaattagttgaaattaaatcaaacgaattgacagtaggtgatttggtatttatccaggctggagatgtaattgctggtgatggacgcttaaaagaagcgaataatcttcaagttaatgaaagtgcattgacaggtgagtcaaatagtgtcgaaaagcagttagttgcaataaatcatcaatgtactattggagatatgacaaatatggttttttcaggaagcttagttacaaatggaacagggcaatatattgttacaaacattggaatgaaaacgcagttaggaaagattgctgagatgttgaatgcaactaaacagcgtcgtacgccattacaaaagacgttagatgaattttcagtaaaattgtcaattggcattatttcaatctgtattattgttttgtttatggatgtctttatcgcaaaagaacaattgctcgatgctttgatgattgcagtagcattagctgttgcagcgattcctgaggcattaggatcaattgtgactattgttttgtcgatttcaactcaaaaaatggctaaagaaaatgcaattattaaaaatttaaatgctgtggaaagccttggttgtgtttcagtgatatgttcagataaaacaggaacattaacccaaaataaaatgacagcagtcgatatatatacaaatcggatgttaatacaagcaaatcgtttaaatcatcatgaatattgtcataatatcttattaaaggcttttgttctatgtaataatgctactatttctaaagcacagagtattggtgatccaacagagattgccttactggaattatatcaagattataattataaaaacgcatatcgattgcagactaaacgtcaacaggaattgccgtttgattccacacgaaagctgatgagtgttacttcaaagaatcatctatacactaaaggagccccagatgttttattaaaacgatgtaatcgaatattaatagatggatataaagaaatttttactaataaagataagcagcgtattatggaacaaaatgatgctttggcgcgccagggaaagcgtgtattaggatttgcgtataaagagttttatcgtaatacattagaaaaaagggatgaaaatgatttagtttttgttggtctagtatctttaattgatcctcctcgcattgaaagcgctcaggcggtcaaagattgcattttagcagggattaaaccaatcatgataactggtgaccatgttgtaactgcgtgcagtattgcaaagaaaattggtatttttaagcaaggtgataaatgtttagagggaactcagttagataaacttactgatcagcaattgcggaattacttgccacatgtatctgtttatgcgcgagttgcaccagaacataaaattagaattgttcaagcttggcaagcacgtggagcaattgttgcaatgaccggtgatggtgttaatgatgctccggctttgaaacaaagtgatattggggtagcgatgggaattacggggagtgaagtttctaaggatgcagctagtatgattctgacagatgataactttgcaactatcgttaaagcaatcattactggccgaaatgtatatacaaatattaaaaattcaattatctatcttttatctgggaatttatccgcaataatttgtgttttagttacatcatttgcaattttaccaactccttttttgccggttcatttactatttattaacttaattacagactctttaccggccattgcgattgggatggaaaaggggagtgatgaaattctaaagcaaaagccacggggatcgggcgattcattacttaataaagagacaattttacaagtgagttttgaagggataataatttgtattttcacaatgttagcttattttattggtttacgcagtgatgaattgactgcttcatcaatggcatttggaacactttgtttggcgcgactattgcatggatttaactgtcgaagtaacttgccactatataaaattcctgtaaattattatagtgttggagcttttgtaattggagtatcattattaacatggattctaatttctcctaattttcattcacttttttcaattagtgaactatcactaaaacaattagcaataatttttgtttctgcagcatttccaagtattattatccaaatatataagatggtttcttcgaggtataattagaaacaaaactaaatataatatattggtggtttaatgaaaaaacgatatatatttattgtaattaccattattttagcaattgttattcaagttcttagtgttaatattactcctgcattaaagaagattgcagacaaagaaataaatcggttttgtcagatggtaatcaacaataccccttttccagttacattagaccatcaggaactgatcaagatcaatcgtaatggtgatgaaattgcgacaattaattttaatacgagttatgcttcaagtattggagctaaaatggttaataaattagatgaattgtttgtagcgattgaagaaggaacatataaaaaaacagataattctttttatcaacgtcgatttcaaaagatgagtgacgaaggtggggtaatcgcttctattcccattggagcattaacacaaaatcctttcttagcaggtgttggacctaaaataaaacttaaatatgaaactatatctgcgattacttgctcagtcgaaaaagatgttaaaagctacggtgtgaatcatgttatggtttctttgaaattggttattaaaattaagatgatggtattattaccattttataacgaggagtttaataaagactatgactatccattagtgatggaaattattgaaggggaggtgcctaattggtatcagaattagaaattttacaacgtttttatcagatctatctagaacaagaaagtgatttctttagttttcaaggtaatttttattatttatgcaaggttaataattttactaatgactatccatactatgtaaatgcattaggactaaatggtttcatggttgttaataactgttttaatcgtcctatctcaatggactatatattgtatacttatcaaatcgaagattatcattttgaaatgtttttacaatattctttgcgacctttagatattcaggttgaagttttaaaaattaaagaaagctggtgtgcaattcttgatgaagcaaagtgcaagattggtaactatgcttcaagaatcagtcattttgaacattttgtagtgctgtcatattactatcaaggtcttggagaagccgcaattagcgtgttaaatgaaattaaagaaactaagctagttgcggggatagaacactttaatatgatcgataactatgagatgctttgctgtccagctaatttagtcatagcttcaagagtcaaggatttagccagtagctataaaaataatttgatttcagttgaacagttagaacagtacattcagattagcgctctaacagtagatgaaataatttatctctattcacgattattgtttccaagtgaatttatgcagctggcaatcaatgatgattgtaatgatgcacaaataaaaaaaacacttttgaatatgtatcaaaatatagataatcaaaaagcgtctttagtaattgcgtggcaaatgttaaataaatatactcgtttacccaaaattgcctggttataaaagccaggtaatttttaataaaataaaaaacccacacttagtgtgagcaatttactaatggagcgggtgatgggaatcgaacccacgtagtcagcttggaaggctgaagttctaccattgaactacacccgcaattttaatgcattaatatgatagcactatttttaaatggtgacccgcaggcgattcgaacgcctgaccctctgattaaaagtcagatgctctaccagctgagctagcgggtcattattaatggctggggtacctggattcgaaccagggagatgacagagtcaaagtctgttgccttaccgcttggctataccccaatgaatggtggaggagggcggattcgaaccaccgaaccaaaggaactgagttacagtcagccgcgtttagccacttcgctactcctccatcatggtgccggctaaaggacttgaaccctcaacctactgattacaagtcagttgctctaccaattgagctaagccggcctattttattttaaatggtggaggttaacgggctcgaaccgctgaccctctgcttgtaaggcagatgctctcccaactgagctaaacctccagtgccttggtgcctaaatatattatcatttacttttcaattagtcaataaaaaaaattataataaattaatttttttataattagtttaatataataagcacttcttttacattttggccatattttaaatatttatgcaaatgaaaagacgatcaaagatcgtcataataattaatagcctggtttaccaagtaatttaaacatatttgctttgtacacttcaacacctggttgattaaatggattaacaccaagtaaatatacagacatagcacatgacatttcaaagaaatataccatgtaaccaaaaccataagcatccattttatctaaagtaatcaaaatgttaggtacattaccagtattaacatgagcatcaacagttccttcacaagcttttttatttacatagtctacagatttacctgctaaataattaagaccatctaaatcatctttatcactaggaatagtgatatctccagctggttctttaatttgcatgattgtttcataaagaacttttgtaccttcttggataaattgtcctaaagaatgtaaatcagttgagaaagtagcactagtaggtaagatacctttaccttctttaccttctgattcaccgtaaagttgtttccaccattcagctaccatagctagttgtaattcgtaagttacaaacatttcagcaggatatccggctttgtgtaaaatctgacgagcaacaccatatttataagcatcattttgatcaagatcagcattaccgtatttttccatcgcatctttagcaccttttaacattgcatctacatcaattccagccattgcgattgggaataatcctactggtgttaaaactgaataacggccaccaacatcatcaggaattacaaatgtcgtatatccctcttcagtagccaaagtttttaatgcacctttagccttatctgttgtagcaacgattctttctttagctccaactttaccgtatttagtttcgcacatttctttgaaaattctaaatgcgatagaagtttctgtagttgtacctgatttagaaattacattgatagcaaaatccttatctttaatataatcagctacttgtttaatataatttgatgaaaaagtatttcctacataaatgatttcaacatcattagttggatataatccgttgattgcttcaattgctgcacgtgcacctaagtaagatcccccaataccacaaactagtaacacatctgttttttctcttagactagcagctgtttctttaattaattcaacttcagctttatcataattttcaggtaattcaacccacccaagaaaatcattaccagctccagttttgttgtgaatcatatcatggatttcttttactttgtccttgtatgattctaaatcctcgcttaatttagctttagataaatctaatgtaatcattttaactttcctccgtgattccttgtttaagccatttttccatggcaagagctaatggtttgaaaccattaggcgtttcaacgattaatcgtctaggattcttatagtaaacacgtttattgcgtctacgataacgattatcaatggctttcaagctaagtttagcatggttagtttcctgatcaaaatcaataacttttactttgattgattcacccaccttaacaaaactatcgatgcttttaacgaatttatcagatatttcggaaatatgtattaatcctgttgaattatctggtaaactggcaaaagctccatatggctggataccagtaattttgacatcaatgatatcaccgcgtttaatcttttggctcatttaataatcactccctgcgtggatattatagcacaaaataaataaaattatttcattttttataaataatacaaaaatcattgataaggcaatagattcaataaatttagtatatttttttattaagtaaaagaatacatttttaaggttgttaaaattaaatttaagctaagaataaagtattacgccatctagaaccaggaataacaatttaaagaatgtagtagaagaatagttattctaaaattatgtgaaaaggaaatgaatgatttgctggtagaagtaagatggctttactagttttaaaagacgattagagaattaatgaatataaataggctggaattattgtccagcctatttgtgtatataagattattttctaaatatctttaaattactgatatattttatttattagtagtctaaaacaataactagattacaattttgatacttggtcacttaatcctttatgctttagaaagattgatataatttgcgatatgagagtaagcattctaagctcttcttttgtccatattcgttttcctgtacattcatcaaagccaacgaaaccggcaatcatttcctgctcatagtacgcacactgtagtgtagaatgaattccttgggcttcaaacagttgtctttgttttttgcttaatgacgtgacatcatgacagtagaagatagaattttcatcgaatactctttcatattcatccatatcatgataagaaatattttgtagttgttcttttacagcggtgatcccttcattacaccattcatatgtattggagcaatgttctttgtctgtcatggtttcgaaaatataagcacggcttacgtcatagcgttttccagtaatttcaagaatcagattaacagctgtttttaaatctttgttttgaaatagaatacgaaaggcgtaatctgctaatgaaacagatgtttcactataagattgttgtgaatcgatagttgcacctagtgaagaatatgcggtaatactttgctgattacaagatttttcattatatacgatatatgtattcttgccttggattttggcttggtaaagggctttatcagcatttgcatacaattccaaaaaattatgtccatcttttggatataaagcgataccaatactgcttgttacctgaatcttacttttctctttgtcaaatagatgggcaaatgttttttgtagttcttcagctttcttttctgcatctaagtggctagtaatatttttcatgaaaataataaactcgtcaccaccaattctaccaacgacatcactatcacgtactttctttttcatagccgttgccatttcacctaataccatatctccagcaatatgtcccaatgtatcattgatttgtttaaaattatctgtgtcaatcatgaagagtgctcccttagagtcatgatgttcaataataaagttttttatttgattttcggtttcagagcggttgtatatcccagttaatgcatctttttctgctttatgctgtaatgtctttattttttgtctttcatctgtaatatctagacccatactataaaaacaagggataccatcccagctgtccctttcatctacgtagcataatgtcagtgtccagatacgttcttctttattacgggtatagactcgtccctcgaatacaacgctctcttttgaatttcttaatttatgaacaatctgcttggctctttttaagtcctcaggatgcatatagctttttaactcataacgttcacttttaaattgttcttttgtataaccaatcattttaagaaaaatatcattgcaccagagaattgaagaataatcccttgcatcaacacgtaccatcgcggcagaaatggtttttaaaattgcttctcgttcttgatctttctttgctagcttatattcagtactataagtgtcatgggaaagctcaatacgagcagagtggccatgccaattcaacatacgatccttgataataaaatttctttttaataaagggttataaaactcccattcataagtttgatctttttttaaatatttatttgtacagaaaggacagggggaacttctaccttgtatgatttcataacactttttccctattgcttgttcagctctagtaccaagcgtttcacatgcaactttatttaaatatagaagttcatatgtgtcaatatcactgatataaacatttccggcattttctgccatcatccattgaaagttatctatatatacatttttagttgaaatgagtgtattctgtgtattgattaaattactaatatcgttatatgcaattgttattacttcgaaagaaagtgaaatagataatttaatccattttatttcatcatgtctaaaaggaattcggattatacattcttgatgtaaatcacgatgctcttgcaactttgctaattgattttcaagaataataaaatcatctgtataaggtttgtagtatgtttttaaatcctgccaaatcattttaaaatcttttttttcatgcccggtcattttataaaaagcatcatttgcccatataaatgagagttttttatcaggtttgtgtttactaattggagttgccagagtatttaaatatttttctaaaatagcattttcattaatcgacattttctttgcagtatttttattgttcatcataaccacccctcctgatatatcacatttatatcacacatatcattcttttattataacatagtaatttgaaaacgctatcttttcgttctgctgaatagttaatgaagttaaaatgtaatattgaaatatctaataaaaaatattttacaataaatttttgttaattttggtagtggtcagatagtataatgatttaatagagagactaaaatttgatagaagcgaaggtattatagtaaagttttgttttggtaattaagtcatagaggattttttatgaagaatgaaatattttatgaatatgaatcattagaacagagtaggaaatagaaggatatttttgttattaagaacaaaaaatcaaaacataattaaaaagattgacttcattatgagtgagaaatcaatccttatatttaaattaaaatattgtgtctagctttgtaattttagcatatatgtacgtagttagaacatttgtcagacagataaagaacctcagtttagtggggctctttatctgtgttacatgtccttttgcatgtttgagaaatgagagttttgggacttatactcatttcccggatatattatatcaaaataaaaagaagaatgaaaaaataatgcactattttttatcccgtaatagctgatatattcttgcaaaagaaaaacagtcattttttttatataaaaaaaataaaaaagttaaacaattaatagtgatgaagaattaatagtgatgaagataggatatttagtagtaatggtctttattaagtatcttgttttacaacaccgtcattacagtgtttttcatccgacagttagtcgattataatatagatcatccaagtgatttttatggtttttagttaaaatcatattatcctagtaattttcttaattaaagtgtatatttatttaaaaataatttttttgtggtaaaatagataagtgctaaaggagtgaaggacaatggaaaatacaagtacaattgaagaagtagaaaaagtaattaacaaattaagaccgtacttaaatcgtgatggtggtgacatcgaattaatagattttaaagatggcattgtttatgtgaagatgttaggtgcctgtgcgggttgttcaatgttagatgaaactttaaaggatggtgttgagcaaatcttaatggaagaagtaccaggagttttaggagtgcaaaatattttagaaggaactgagtattaatttaaaacaaagttgagacaaaaaaagattcattccatgctaaaatattagtatctaataaattgcttgcaataatgtcttagatatattattatgtatttgttgttttaaggaatattattttttaatttatgcaaactaagttaaggtgataatatgaagaatgtaaggcaacaaaaaatgattgccagtatcttattagatattggactcgatgacgatattattgaggtaataacgtcactaactaaagaagaaatagaacaaataaataaaaaagactcttattaagaactactagatgaagatcgatgatgtagtggcaaccctatattaaattagaaggtgcctaactgagcaagtttatacttgaacaatgagagaaggcttcctaactatgtatgctttctctttaggaagcttttttatttgtagaaggagaaagaaaaatgaaagaaaaagtattatttacctctgaatcagtttcaaaagggcatcctgataaagtttgtgatcaaattagtgatgctatccttgatgcgtgcttaaaagaagatcctaattcacgtgtggcctgtgaagtttttgctactactgatctggtagttattggtggagaaatcacaactactgcagaagttaactatgagcaggtagctcgagatgttttaaaggacattggatatgatgatagcgataaaggaatcgattatcggacttgcaaggttcaggtagtaatggatttacagtctcctgatattgctttaggaacaaatgacgaagtgggtggggcaggtgatcaaggaatcatgtttggttacgcctgtaaagaaacaaaagggtatatgcctttgccgatttcaattgctcatcatttggttcgttatgcaactgaaaaaaaggatactggagaatttaagtcagcccgtcctgatatgaaagctcaagtaacgattgattataccgaaagtactcctaaaattgatactattttaatgtcgattcagcacgatcctgattttgatgaaactgaattcaaacgttatattaaagaagaaataatggatgcagttgtaagaaaatataatttaaacactgattataaagtgctgatcaatccaactggtcgctttgttattggaggaccgcatggtgatactggcttaactgggcgaaagattattgttgatacatatggtggggctgctcgccatggtggtggggcttttagtggaaaggatccatccaaagttgaccgttcagctgcctatatgttgcgttatattgctaaaaatattgttgcggcaaatctttgtgataaattagaaattcaggtttcttatgctattggagttaaagaacctacttcaatttttattgagacgtatggaactgaacatgttgaccatgatataatcctaaaagcaatcagagataactttgatttaactccaggaggaatcattaaaacgttagatttacgtcaaccattgtatctaaaaacagctgcttatggacactttggtcgtggggataacaatcttccatgggaagagttagataaagtagaaattctaaaaaaatatttatagataaaaatgctcgatttattcgagtgttttttgtttatgttaaatttagggaaattttatcaataatttgagtgttattttacaaatatatattgtataatatgtttatacaaaggaggaattcttatgaaaatctcagtaagaggaaaaaacattgaaatcacagaggctatcgaagcaaagatttcagaaaaactatctaaattagataagtatttcatcgtaagtgacaatgttgaagcaaaagttttatgtcgagtttatccttatggacaaaaacttgaagttacgattcctactgaatatgtacttttaagagcagaggtcgtagatgatgatctatataatgctatggatctagttgttgacaaattagaaggacaaatcagaaagtacaaaactagactaagtcgtaaatcaaaagataataaacttgcgttcaacctatcttcaattgaagatgttgaatctgaagaagatgtcttggtaaaggttaagtcaattacccctaaaccaatggatatggaagaagcaatcatgcaaatggaattgattggtcattcattcttcgtttatcgtgatgttgaaagtgattcaattagtatcgtatatcgtcgtaatgatggtgattatggtttaattgaaactagtaattaataattgaataatagaaaaagccctaaatgggcttttttattttacaaccttgataataatctttagcaaccattaatttatcaatatcatttaagatagttactttacgaattgaccataagggagcgactaaatctgaaatatttccatctccggttaatctttcaataacaatattttctgggatgtaacttaattgtttgacaactaaatcaatatattcgtcacgactcaggattttaaaaggctgttgtaaatataactgatgtaattttgttttttcaatgacataaagcatatggatctttaaggcttgaatgtccaactgcccaaccgcctttgctgtttcaagcatcatttcatatgtttcaccaggtagaccattgataatatgtacacagacattaatttttaattttcgtaatttattcaagccgtctaggaagtcttgataattatggccacgattgattagttcacctgtttgatcgtgaatggtctgtaaacctaattcgacccataaatcgcagcgattattaacttctgctaaataatttaaaacatcggtttccaagcagtctggccgagttgcgatgctgattgcaaccacattttttttattgataaatggctcgatacaagctttgattttttttaatgggccgtatgtattagtattggcttgaaaataagcaatatatttacaatttggccatttattttgaagaagcaaactaacattactaaattgtatttctaatgaatcctggatatttccggcaaaatcacctgaaccagtgctgctacaaaaaatacagccgcccgtgcctttagtaccgtcgcgatttggacaagtaaagcccgcattcaaactaactttggcaactttactttgatatttatttttcagataataattaaaagtatgatagcgtttattatcatcactatatttaaataagttcattttatcaccattgctattataacataaggaggacgttatggcattacaacttattaatattactaaattttataagtatggaaaaaagagacaacgcgttattgatgatctaacaattaaatttccaagtagagggatgataggaatcattggtcaaagtggtacagggaaatcgactttgttaaacattattgcgggaattgagcgtccatgcaatggtcaggtattaattgatgggcataggctcaactatcaacaaattagaatgtatcaacgtgattatattagttatgtttaccaattttataatttagtcaatgctttaacaataaaagagaatttaatcttaattacaaaaataaaaggtattgatttaaagcaagtgtctggtcaattggaggagtattgtcgaactttaaaagtagttgaattgttggaaagatatcccgatgaactatcgggtggtcaaaagcagcgaattggattggttcgagctttcttgtgtaatacaccaattcttttagcagatgaaccaactggagcattaaatgataaattaagtattgaagtgatgagacttttaaaaaggtatgccaaggagcatttagtgattgttatttcgcataattctcgattaattaaacaatatacaaaaatgattgtagatcttgataaaaaaaagaattattataattttagtaatgaacgatatcataaatattcaccaataatcataaaaaagcagctaggtcgactgcttttttattgtaaaaggcaactcaaatatcaatttaaaaagataataatgatgtttgtatcacaaatatttattattctagcttttgttttattattaagtgcttttaatggtggatggcaatatttagaaaaaaaatttgaagaagacccattaaaaagagttattgaagtttcaaaaaatgattatattaataatatctttgaacgcaaagaaattaaaaaatttgagaagaataataaaatagcaaatgttgcttacaaattagtatttagtaatggaattttaagcagttatgatgaagagttagacgttgaggtatatcagatatttaaaactaaaaagttagattatatttctgggaaatatccttcaaaagagaatcaaatattaattaatcagacaacggcaaagaagtataaattaaaaataggcgagagaattaattttgaaattaatgatgatgaatatgaattcactattagtggaatcattaatgatcatattaatataggggttaatctttatttagaacaacagtatttagaagaagagttaagtgatgattgcctggataaaacagttttaatatttcatagtgatcaagtagatgctgtgataaaagaatatcaaaaagattatttgctgattaatctacacggtgattatattgacaactatcgatcaatttttgatatcactagatttgtgattttcttatttattgtaattagttttgctatttcattaattttaatttcagttattcttaaaacaatttttattgaacgaaaaagagatactagtcttttattggctaatggtcttggtaaaggtaaagcaattaatttattttgtcgtgaagcaattttgataggagggctgattggaagtgcgggagcaatcttagcaatgggcgtattaagattaattgagctatttgatttaagtgattatttatttaacattccaaggttgtttgtcttaccgaaatatatttttacaaaatatgatttatatgtagtgttgattgttatttatataattgcatgttatttagcagggttacaagctagtcttaaaataaacagaatggatattagcatattgttaaaggagaactaaaatgctggaaattaaaaatttaactaaaagatatgatgaaactattattaaaaatttaaacataatattaccaagtacgggattgatcataatagtaggaaattctggatgcggaaaaacaacattattaaatctaattggtggaatagatcaagattatgaaggagaaatattatttgatcatcaagatattcgaaaaattaaaaagtattgtcgtaggcatattggttttatttttcaggatttcaatttaattaattggctaaatgtcaaagaaaattatttgttagcaaaattttttactaaaatttcatataaaagagcagttgaagatcaagaagaaaaattagaactccgaaaactgaataaaaaaagggtcaaaatcttatctggtggacaaaaacaacgggttgcattacttcgggcgatgattaaaaatgttgatattttattgtgtgatgagccaacaggttctctagatgataaaaatgcaaagatggtttttgaattattacatgcagaagctaaggaacgacttgtcattgttataacacacaatgagcaattagcttatcaatatgctgatcaatgcttttctatgcaaaatggacaattgattgggaagtatcgccgggataaaaataatcatttttattcgcgtttagtcaaacagcattcaccattaaaattatatcaactggcattgttacaatatcgtgctaatttgggtagaaatttaaaaatatcatctggtattacagtagctttgatttgtattatgattacctttacactgagtggatcattacaaacccaaataaaaagacagcttgattctatatttccaaatcaactaatttcgattcagaatgtacataaaaaattacttagttatcatgagttactttcattatcaaatttagatatgaatgaatttatctatggggaaccagccgattatgaatttatgggagtatcactgcaaagtgattatgaagttgaaaaaacaatttatatcagtgatatgactaaaccaataaaaagtaggaatttggaaataggacgtgaaacaaaaaatagtaatgaaatagttttatcaaaaacaacggcaacacatcttaatcctgattatcaaaaattattgaatcaacaattatatggatattatttaaaggacgatcaaattaaaggagtctcactcactgttgttggaatagggaaagatgtaactacttttgacacaatctatattaatgaattagctaatctcgatcatattagccaagcttttgcgattgataagaaacaattattgtttcaattagctatgatcaatttaaatagcaaagcggatcttgatgatcttttaatggatttagaagatcagtatagtcaatttgaatttaaagttgcaggagaaaatattaatgaaagaatagatacatttatgttacaaattcaaagagttcttttactattttctttattggctatagtagcagcatgtttcttaattggggaagtgttatatttgtctgttatagaaaaaacaaaagatatcggtatttttaaatgtatgggtgcgagtaaattacagatcatgaatttagttttattagaaagttttactttaattagtggagcgtttatctgctcttatgtatttttttatcaattagttaatttaattaatcagcttgttgaaaatgagctgcagcttgatttatcaggagtgtttattcaaattgattatcagttagtaattgctatctatttaggagcattatgttttggattgtgcagtagctatattcccgcctttttggcaggccggttagatcctattaaagcattaaaacaaccaaattattagtaataaaatttgttgcatatcagcctttttatgttataatattctagtatttgaaagtcgatgaataggactagtagtaattgacgttttttatagagaatcagtggctggtggaaactgataaaacgggttatgaactcacctaggagatgcagcggggaattaagtagtcgttgtcgttaactgcgttaaagttttgagggctaggtcttttagacttggaactaaggtggtaacgcgattaaaagtcgtccttagataggatgatttttttattttaaggaggaattataaaatgccgtttgatcacaaacaaatcgagccgaaatggcaaaaatattgggatgagcataaaacatttaaaacagactgctacgatgatagtaaaccaaaatattattgtgtggatatgtttccatatccgtcagggaatggtttacatgtagggcatccagaagggtatactgcaacagatattgtttcaagaatgaaaagaatgcaaggatacaatgttttacatccaatgggatttgattcatttggacttcctgcagagcagtttgctattcaaacaggacatcatccagctgaatttactaaaaagaatattgaggtatttaagggacaaattaaatctttaggtttctcatatgattgggatagagaaatcgcaactagtgatcctgaatattataaatggacacaatggatttttacaaaactttatgatgccggtcttgcttatgtagatgaaattcctgtaaactggtgtccagaacttaaagctgttttagcaaatgaagaagttattgatggaaaaagtgaacgtgggggatatccggttatccgtaagccgatgcggcaatgggttttaaaaattactgaatatgctgaaagattgcttgaagatttagatgatcttgattggcctgaagcaacaaaacaaatgcagcgaaattggattggaaaatcagttggagctaatgttgattttaggattgatggaacagataaaatatttacagtctttacaactcgttgcgacactttatttggtgcaacttattgtgttatggcacctgagcatccatatgtagctgaaattactacattggaacaaaaagaagctattgaagcttataaagaaagttgtgcaagtaaatcagatttagaaagaactgaactaaacaaagataaaacaggtgtttttacaggagcgtatgcaattaatcctgttaatggtaagaaaattcctatctggatttctgattatgtactagcaagttatggaactggtgcaattatggcagtaccagcacatgatgatcgcgattgggaatttgctaaaaagtttggaattgagatcatacctgttttagaaggcggaaatattgaagaagccgcttatactgaagatggattacatattaattctcaatggttagatggactaggaaaacaagaagcgattgataagatgattgcctggttagaagagcataagtgtggagaaaagaaaatttcttataagttaagagactggttattttctcgtcaacgttattggggtgagccaattccaatcgtacatatggaagatggaacaatgagaaccgttccggttgaagaattaccattagaattgccagctactaagaattttcaaccccatgatagtggtgaatcaccattagctaactgtgaagattggttggaagtagagattgatggtcaaaaaggtcgtcgtgaaactaatacaatgcctcaatgggcaggatcttgctggtactatattcgctatattgatccacataatagtgaagttatttgtgatcctaaattgttagaaaagtggttgcctgttgatttgtatgtaggtggtgctgagcatgctgtattacacttactatattctcgtttttggcataaagtattgtatgatgctggagtagtgaaatgtaaagagccatggcaaagattattccatcaaggaatgattcttggagataataatgaaaaaatgtctaaatcacgtggtaatgttgttaatcctgatgatattgttgcttctcatggtgcagattcattaagattatatgagatgtttatgggaccattggaagctgctcttccttggtcaacaaatggattagacggttcacgtaaatggttagatcgggtatatcgtttatttatcgaacaagataaattaagtgatgaaaatgatcatagtcttgaccgtgtatatcatcaaacagttaaaaaggttacagatgattttgaaacattaggatttaatactgctatttcacaaatgatgatcttcattaatgaatgctataaagcagagacagtatataaagagtatgcatttaattttatcaaaatgctttcttgcattgctcctcatatttgtgaagaaatgtggcaaatgttgggacatgatagttcgattgcatatgaaacttggccaacatatgatgaaaatatgttagtgagcgagacagttgaaatgggtgttcaagttaacgggaaacttagagccaagattcaagtgactaaagatactgatgatgaagctgtgaaggaaattgcgtttgaacaagaaaatgttaaagctcatactgagggtaaaaatattgtaaaagtgattgttgtaaaaaacaaaattgtcaatattgttgttaaatagttataaataaaggaaactgtaacgcattaaaattgatatgcttctttctggggagacaagtgaaataataaaaacttgtcacttaggaggaagcatattttatgtctaaaagaaaaatatccattgaggataaggtatatgctgtaaatttgtatctagatggaaaagaaagccaaaatcgaattgtatctatgtttggtgtcagcaagctgttttagattatttagatggtcgtggttccttggatgatatttgtaaaaaatacggaatttgtccaagattgaagttacaactctggataaagaagtataataatcatgaagagttaaaatcatctgaaataggagaacacactattatgacaaaaggaagaaaaactgcatttggaggttgtacagagaaagctctgaaaacgaacaaaaaaacagacggattactgatgagattgaaaagctccatacagagtcaccagatagaggataatgaagaattagagatgatctagaatgttatcatgacattgatgttaatgataaacgagtactacgtactacttaatatcaaatcaactattaaatactctactaatggatgtacaggacaggctgtaaatcctcaatatatagctaaaaatttacttaatcgagagtttactaccgatgcactaaatgagaaacggctcacagatgtaacagaattccattattatatcagaatcgaaaaacataaaatttatttgcaaatcgcataaaaactgccagtagataatctaccggcaggaaaaattttatattttttcaattgtctatttgacaggttgcagttcactttagacgttacagccttttttaaatacattattaattttattgtatactaatgagaattatatataaaacaataatatatagtttttagctatttttcatataagtcactaattgatcaacggatataccatgttgagctaataattcatcagcattaaaatcagtatgaaaggccttggagataccataattcttgactttcatctctgtcataccgtagaaactgcttattctgtgcccatatccaccttctaattcaccatcttctaaagtaataataagacgatgattattagtcaagtcatttagtaattcttcatctaaacctgttagaaattttggatttattacagtgatatttttaccggtatcctctttgtatttttgagctgtttttaaggctaatggaagcagattacttactccgataatagcaatatcattaccttgttgaacaatttgagatttattatggatagagtaatcagttgtgtcttcttgaccactttcaatcatttgtactgggactctgattgcaattggatgatctttttgggtagttgcatatttaaacatttgtaaatactcttctttagttgtcggcgctaaatagattaaatttggaatatgtgcaaacattgcaatatcacataaagctatatgagtatttgaattcatcccatagactccagcggatagaacaagaattgttgctggattattgttcagacataaatcgtgagatagctgatcatatgtacgttgtaaaaaaggagcaaaagttccaaagacaggtattccgccatttttagcaatcccgctaatcattgccatagcattttcttcagcaatgccaacatcaataaattgtccacgttcgacatattcttttcttacaggttcgatgaatcctagccccatcggtgtaccggcatttacaacaatagcctttttatttgcatttaataagttagtcaagctatcgaatagggtttgatcatcttcatcaacaaatttatatgttccatcagcaacattaaatggaccaccagcatgccaagcttccttgtttacctctgcatatggtaatccttttcccttgattgtatggatatgcaatacgatagggtgatcgatatttttaacactttcaaataattcaattaatttttcgatatcatgcccatcatctaagtatttataatcaagaccaaatgatgtaaatatattgttattacttgttccgttagtgtctcgtaattctttaagcgtttgataaataccgccatgattttcggcaatactttgatcattgtcattaacgataatgatcaagtttttattatattcgcctgcataatcgatagcttctagtgcttctccacctgataaagaaccatcgccaataatagcgataatattttcggcttttttattcaaatctcttccaattgctaacccaagagcaagtgatacagatgtagaagtgtgaccaattgtaaacatgtcatgttcactttcaagtgggttggtatatcctgttacgtcatggaaatgttcttcatctagaaatgcctcttttctgccggtcaatattttgtgtggataagactgatgggaaacatcaaaaacgaatttatcatttggtgaatcaaaaacataatgtaaagctactgtcatttctaccatccctaaattgggaccactatgtccgccggctttactaatcttattaatcaatgctgctctaacttcgttagcaagttcttttaattcttttctattcaattttttaagatcgtttgtatcgtctattttttctaaaaacatatttacctcccatataactagatactataaaaaatactttttataggtgataatatcatacatcttgaagtttacttcaagtcaagagaaaaattaaagtagtttatgagatgataattagaattactgtactgaacatatttattaatagaggaaaataagtataataaaagaatgaagtatagagtagattaattagtaattttatgataagtgaaaagtgataagtaaaaaaggtgattttttgatacaatgaagttcactacacaaagtcacctttttcatttgattaatataattttaagcagttataatgcattttcgaggacatttttctttgcaaagtccgcaatttgtacatttagtataatcaatccgtgctaaagagttttcaataataattgcattattaggacaattacgagcacatataccacagccaatacaactaacagcgcaatttttacgagctcggagagctggttcatttgaattacattttactactgcctgtttttgatatggaatcaaagtaattacattatttggacagactctaagacatttaccacatgcttggcacaagtctggattgataacggcaaccccatcaataattgaaatggcattatattcacattctctgacacaactgccgtatcccatgcagccgtgactacattgtttatctccaccaccagggacgatggctgcgttattacagtctttgataccgtgatataagtactgaatcgttgcattttcgcaagtaccaccgcaacgaacaaatgctgtcattcgcattgtttcttcactttctactcccatgatcattgcaatggcgtcagctacactttttcctccaacaggacattgattgatctttgcttcaccagcaacaattgctttggctagcccgtcacatccgggatagccacaccccccacaattatttccaggaagttcttcacgaatttgaatttctttttcattaacagtaatggcaaatttttcactagcaattgtcagaagaataccaataagtaaaccgattgcacctacaataatggccgcaattataatttcattcatcttatattctcctccttatattagacctgaaaagccaatgaatgcaattgccatcagtcctgctgtgattagtacaatgggggaaccttggaatgaaacaggaatatcattatcagcgattttttcacgtatcccagccataataacgatggcaatcgtaaatccaacagctgttccaaaactacaaacaagacttgtcaaaatatcataattattttgaacatttgtgatagcaactcctaaaacggcacagttagttgtgataagaggaagatatactcccaaagaactatataagccagagctatatttttttaagaacatttcaactagctgcaccaaagcagcaataactaagatgaaggtaacagtgtttaaatattctaaatggaagagtactagtattttgtaaactaaacttgttgcaattgaagcaatagacattacaaagatgacagcaccacccattcctgctgctgtttcaattttttttgatactcctaaaaaaggacatagacctaagaattgacttaagacaacattatttactaaagcgacactaattaataataaaatcattcccgtcatttatttttcctcctttaaatcacaaagtgccttttcatcactgctacgacaatgaagacaatcatgattacaattaccatctttgtttttattagttgcacttggcagttttaaacggttttgaatagccgttagaccagctaaaacaaagaaagcgccaggtgccattacaaagatagttacaggttcaagatgagcaaaaaagctataaatattagtgccaactaaatctttaaaaagtggcgcaaactcaattccaaaaaaagtaccactgcccaacatttctctaattaaaccaatacaagtcagtgcaagcgtaaaacctagccccataccaacaccatcaaataacgataaaacgcaactatgttttgaagcgtaagcttcagctcgtcctaaaatgatacaattaaccacaattagaggaatatagatccctaatgtatcatataatgaaggcaaatatgcttgtaatagtaattggacaattgttaccattgaagcgacaattacgatataagaaggaattcgcattctttcagggattatttttcgtaagaacgaaatcataaaatttgatgcggcaaggacaatcatcgttgttaagcccattcctaatccattgacagaagaagttgttactgcaagagtaggacacattcctaacattaaaatcaaagttggattttcttttatgattccattataaagacgttcaacatatttattcatgattagcctccttgatttcctggttgattgctaaggctccgttaatagcattgttaaaagctgatgaagtaattgtagctccgcttagagcatcaatttcatcttcattttgcttaccagttttggtgattttaaaatcagttactgatttatgataatattgatttttaaaattatcatttttagcattcattcctaatccaaccgtctcatcaattgagaggacttcaattcccgtaatttcattattagtatcaattccaacaactaatgtgatatcaccgccataaccatcttcagtagtgactttgacaacatgtcctattaattcttttttatcatttgtaacgactaaaacgtcgtctatcacaatgccattttcaccaaagttatattttttgtcttttataacattaggaaaatttttaacaagttgatttatttgtttattattatcaaaattttgaccttctttaaaaacacttcgataagaatcttgtatgattttttcattttgtctagcaattgggtctttggtaatagaattaaccatagctagagataaactagcagcaactgtaattacaacaaaaacgagaatatcttttagaagattttttttcattatgctttacctccactaccttttattttaggcactgttactttttcaatcaaagggacaagtaaattagtaatgataatagcaaatgacattccctcaggagtattaccatagagcctaaaaacagcagctaatattccaataaccagtccataaataattttaccggttggagtaatcggacttgtcacatagtcagtagccatgaaaaatgccccaatcattaaaccgccaccacaaatttgttgtaataaaaatagactgttaaagttattattgatcaaaatgattaaagaaaatgaaaataggatacacaacggtattttaggactaattacttttcgataaattaggtagacagcgcctaaaagcagagcaattactgatgtttcaccaatcgtaccactagtatttcctataaacattttgagaagattgacattttgtccattttgtatcattgccagcggagtagcactagtacttgcgtcgatgctaacaaagctgttcatttttccggcaaatgaaattaataaaaaacatcgagctgctaaagcaggattcataaagttctgaccaagtccaccaaaaagttgcttaacaattataactgcgaatatacttcccaaagcaaccatccacaatggcaatgagcttgataggcataacgctaataataagcctgtgatggctgcggagccgtctttaatcgtgactggcagcttcatcaatcgttgatacaaatattcacttagaacagctgtaataatagcagttgtaataacaagaaacgcattaaatccaaattgataaattccaaaaaaagttgctggtaataaagaaatgattacgtcatacataatatttttagttgtaattgaactacgaatatggggagcagtagacacattaaataaattatccattattttgctcctttcttgcgatcgtcattaattgctttttttatttttttaaatgattgtgtcatgtttcgctttgcaggacatgtgaaggtacagcagccgcactccatacaatcgttgccgtgaacctttaaaaagttttctttatcgcctgttctggcataacggtatagtaattgtggaataagaccgatagggcaaacatcgacgcatcggccgcagtgaatgcacgcagttggagcggttttagatacttcatcttcacttaggcaaactaaagcagaagaagttttagaaactggtacatctaaattaaataaagcagtacccatcatgggaccaccagaaatgattttttgaggatgtattttaaaacctccacaagcgtcaacaagggtctgatatttagttcctaggcgaaccttaaaattttgtggttgaaagattgcatcaccagttaccgttacaatcttttcaattagtggaatatttaaggcaacggcctcatagatagcaataatagatgcaacattgctgacaatacagccaacatcagctggcaacatcccatctacaattgtttgattagttaatactttaatcaatacgcgttcacttccttgagggtattttgttggtaaggctgctatttcaattttatcttcatctacaacgactttttttaaatgagctaatgcttctggcttattatcttcaatagcaataattgctttggcatttttaaataactgtaattgaattttgatgccagcgattaatttatctgtttcttctagcattaaacgatagtcagaagttaaatagggctcacattctgcaccgttgataattacatatttaattgagtcatcatctttaggggtattttttattgcgctggggaagccggcgccacctaaaccaacaattcctgcgtgagcgataagttcacgaatttgcatactgctataattatgataatcatttgttgtgttgtattctggaatactttgatattggtgatcgttagtaataacgatacaatcaacaaaaaaaccagtaggggcaagtcgtaaatcaattgttttaacggttccagagacagaactagcaacattggcagaaatcataccgtttccattagcaataatttggccaactaaaacatgatcacctttagcaacgatagctttagctggagcaccaatatgctgtgataatggataaatcagttcatcaccaggatttaatagtttgattggatgattggcggaaagacttttattatcatggggatggattccgcctttaaaacttagtattctcatttgaattaaactccttttttggactatattttaattatagactttttataattaatattaaatagtttagacaagttaaaaaattaacttaaaaagcaatcctttcaagaggattgcttttactagtttataaatgaaattgagattcatcaagacgtagactataaccttgtgggtgtttacaaactgggcagatcgttagtgcatcagtaccttcataaataaaaccacagttcatacacatccattttacagtagactggtcattaaataatttaccactggttaataaattatgatattttttaaaacgttcatggtgatagtgttcaatctcacaaatcatgtaaaaagttgttgcaatttcaacataaccttcttctttagcttcatcaccaaattgcttgtagatagatgttgcttcatcgtattcgtgttgtgctgcttgttctaataacgaacttaaatcctgatctagatcaacaggataattagcctccattgaaacattagcatctttaaaaacatctttaagataattgtaaaaaactatcgcatgctctttctcttgatttgcagtaaaataaagcatatcttgtaaaatagccattccattcttacctgcgactttagcagccatttcataacgcattcgagcttgacattcaccagcaaaagctcttaataaatttgttttggtttttgtttccatatataagttacctccacttttatttttaacaaaataaaagaagattaaacttaatcttctaagaatcaaataatctctttaataataattaaaatattataacgctgatatagatactgctaacaagacaaataatctagttgttcatatctttattcattccagttaattccatatattcagttttaacatttttcaataattgcataaatgtccaatttacatttgtttgagttacaattgcctttaacggaatgaaaggaatgtttgcttctttaaaaatttgtaatagcaaatcaacttgtttatcttcaaaaccagccataaccatcatgtcatcttgtggaatctctgttaatgcttcagttccacgttcaaaattatcagcacctaaaatatacccaatcgggctcattaaatcacttgatttaacaatgattacttcaacattcagtttttcaagaattgaaataattgctttaccagcatcagttttatcaatattgtataataatacagtttcttgcatatgtattgcctcgctttcgtttaataggttatcatatttatggttaacgttcaactaagttgacttaatgtgctataatttattcgggtaggtgagataatgcggtattatttagaaaaagaaattacaaatagttataaagaaggaagcttagttattgatattcttagtaaagaagatttcataaaccagtatcaaaaggaaaatcatgcaaaccatgtgattaggcatattggggatattatgtactgtaaagtagaattattttacgatgtgatttgcggagcgtttgttatacctgacaaaaaggatttaaaaataaaacattgttttagtttttatttaacagaacaaaaaatgatttttattgatgataacgattatgtgatgaaacttattgaaaaaatgaaagatacatatactaataatcgtctaagtttgaacaaattttttcatgatttgattttcttaataactgttgatgatggaatgtatttacaagaatatgctgatcgtttacaggtcatcgaagacaaaatagcttttaatttcaatagtcaaataaataatgagataatcttgctgcgtaaagaactattaattttaaattcctattataatcagttgggggatatgatcgatattttaagtgataatgaatcagatttcttaaatgattatgaatgtcatttattcagcatgcaggcacgtaggattgatcgtttggataaccagttaaatgctttaaaagattattctttgcaaataaaggaaatgtatcaaaataaaattgatacccaccaaaataaaattatgactgttttaacagttgcaacaactattttcttcccgttatcgattatcacaggatggtatggaatgaattttaaaaatatgccagagttaaataatccttatggttatattattgttattggagcaagtattttagttgtaattattgaaatgttaattttgaaaaagaaaaaattcttttagaaaaaaatgttgacgtagtcaataaaaaaaggtatagtaaataagcaacaaatgatagcagcacatagagttttgaaaagagcgtttataacttaagtttgtagagtagctagctgcaaagtgaaatacttaatataaacacaattcaaataatctatgcaatgttattgttttatgcaaataaaacaataaatggaggaagacaaatgtcacgttacacaggacctcaatggaaattatctcgtcgtttaggattctctactttagaaaatggtaaagaattaaataagagagcttatgctccaggtcaacatggtcaaaaaagaaaaaaacaaacagaatatggtttacaattagctgaaaagcaaaaagtaagacatatgtatggagtaaatgaaaaacaattccataacacattcaaacaagcaggtaaaatggaaggtatccatggttataatttcttctgcttattagaaagaagattagataatgttgtttacagattaggatttgcacctacaagaagagctgcaagacaattagtaaaccacggtcatttcttagtaaatggaattaagactgatattccatcattccgcgttaaagttggagatgttattgaagttaaagaaaaatctaaaaatttagcaatcattaaagctagcttagaagctagagtacatactcctgcttttgtagaagttgatgatactaaattaactggaaaacttgctcgtttaccagaaagatctgaattaaatcaagaaatcaatgagtcattaatcgttgaatactataaccgtatgggataatccctacgggattaaactggtatatcttaactatgcagaagttaggatatacttttttttgaatttgattcttcgttagattattaattgctggtttaaaacgacagttttgccatcctgtttaaagaacgagcgcacaggttgatagcaattataattatttataaaatggtaagaaaattattttttattggtttaaaattaaaaataattaaaatgatattccggataaccctaagaaaaaatcatataaaattgaaaaaagtatttgcataaaaaattaatttaataatgtattaattttgataatttgatataatcaaattaatgtggaggtatgtatgacagatagtagaatttgtattgccttggattttcaaaataaggcagaagtaaaagaatttttggaaaaattcaatgatgaaaaactatatgtaaaagttggaatggaactattttatggtgaaggtattgaaatcatcaaaatgattaaagaaatgggacataacatttttttagatttaaaattacatgatattcctaatactgtaaaaagtgcaatgaagcaactagcaaaattagaagtagatatggtcaatgttcatgcttcaggaagtatcgcaatgatgaaagctgcaattgaaggattagaagcaggcaagacaggtgataaacgacctttatgtatcgccgttacatgtttaacgtcacttgatcaagaagtgctagataacgagcttttaattaacgatacattagaaaatgtcgttttaaagtgggctactaatgctaaagaagcaggacttgatggtgttgtttgttcaccattagaatctaaagtgattcatgataatttaggaatggaattcataacagtaacgccaggaattcgtttagctgatgatagcgtaaatgatcaaaaacgggttactactccggcgatggcacgcgaattaacatctagttatatcgtagtaggtagaacgattactggatctgctgatccatacgcaacatataaaaaagtatatcaagattttcaagggtagaggagaagaataatgaaagaattaattgctaaagatttattagatattcaagcggtttttttaagaccaaatgaaccatttacatgggctagtggaattaaatcaccgatttattgtgataatcgtttaacattatcatatccaaaagttcgtaaagatgtagaaactggactagctaaattagttcaagaaaattttccagaagcagaatgcttaatgggaacagctactgcgggaattgctcatgctgcattagtggcagatattttggaattaccaatgggatatgtccgtggtggggcaaaaagccatggtcgtaacaatcggatcgaaggaaaagtagaacccggcatgaaagttgttgtggtagaagacctgatttcaacgggggggagttcattagaatgcgttgaagcgctaaaagaagccggttgcgaagtaattggaatgattgctattttcacatatggattaccaaaagcaacaattaattttgaagcggctgaatgtaaatatgtaacattgactgattatgatacattgatcggtgtagcaaaagaaaatgactatattaaagaagctgatatggaaaaattaaaggcttggaaaaaagatccaagtgacgaaagctggatgagtaaatagaaggtaaaaacaccttctttttttatattttccccctaaaataaagatattttaattgcattatcattgtgctataattataatgctattgttgtaaataaaagtagctttggaggtagaaaatgctaaaaagtattaaatatgttctaaaagagaatttctcaaatttatttagaatatattcaatttcgaaatatgaattattatctgatattcgtgattcccgtttggggattttttggaattttgctaatccattgattcaaattttaacatattattttgtttttggtttagtaatgaatcgtaaagatgtagatggaattccttttattcaatggatgttggcgggaatggttgtttggttttttattaatccttgtattactcaaggggctaatgccattttttcaaagacgggtgtaattactaaaatgaaatttccagttagtgttttaccagctacggtagttttaaaggaattatttaatcatgcctgtatattgcttttaatgattattttttattgtactcaaggtgtctatccatcaatcgagtggttgggaattatatattattgctttgcggcctgctgttttgctgtgagtttagcgatgattacatctgtgcttaatatgattgctcgagatactcgtaagttgattttagcgtgtatgcgtttgattttatatttaacacctattttatggccgatttctcgttttagtgaacagacgttattgtttgatattattcgttttgtcatgaaaatcaatccaatctattatattgtatgtgggtatcgagattgttttttatatcaccttggatttatgcattattggaaacaaatgctggctttctgggggattactggaatactgtttgttgttggctgttatatgatgtataaattcaaacataaatttattgatatgatctaggtggtagaaatggaaaattacgcaattaaatttgaaaatgtttcaaaaatatataaattgaaaaagaaaaatgatggtaatactaaaagtagtgaaacaaaaagattttatgctttaaaaaatattagttttgaaattccacaaggggaagtagtagggattttaggaactaatggctcaggaaaatcaactctgtcacttatcttggcgggaattagcgaaatcgatgagggtgtcatgcatattaatggtgaacaatcattggttgctattaataccggtttaaataaacagctaacaggtttagaaaacattaatgttaaaggtgctttattaggactatcaaaaaagcagattcaggagattattgatggtgttattgaatttgcggagctaggagactttttatatcaacctgtaaaaaaatattctagcgggatgaaatcacgacttggtttttcaatctctttatatttaaatccagatattattatcgttgatgaagctttatcggtaggtgataaaggttttgcacaaaagtgcataaataaaatgaatgaattaaaagatgaaggtaaaacgattatatttatttcacattcattgcctcaagttcgaaatttttgtcaaacagcaatgtggattgagggaggaatgttaaaagaatatggtgaagtcggggaagtatgtgatcattatggtgaatatgttgattactataacagtttaacgaacaaagaaaaggctaaaataagagataataaatttaaaaaacgaattgttcaaaatcctcaaattggattttgggaaaaagttttagatcggataaaaggataggtgaaaataatgaagaaggttattacatacggaacatttgatttatttcatgtaggtcatttgaatattattaaaagagcaaaagcgctgggtgattacttgattgttgcggtaagtagtgatgcatttaatgcgcagaaggggaaaaaggcatatcatagtgatcatgatcgaaaattgattttagaggcgattagatacgttgatgaagttatttttgaggaatcttgggatcaaaaaattaaagatgttcaagaacatgatgtagatgtatttgtaatgggtgatgattgggaaggtaaatttgattttttaaaggattactgtgaagttgtctatttaccaagaactgatggtatttcaacaacaaaaattaaggacgatctacataaataggtgtaaagatgaaacttagtataattatcccttacgatcgttacaaacagtatttacatgattgtctagaaagtgtttatgaacagcggttaaatgattatgaaactttacttgttgtaaataataaaaaagagattgatcaagatatcaaagcgtatgatattaatttaaaaatccttgaagctggagaaaattctagtgttgctaaaaaaagaaatattggcttagaacaggcaagtggtgaatatatctattttattgattgtgatgattatttgatgccaaatactttaaaattattaattacttgtgctaatcaaaatgatttagatttagttgcaggaattagacgctttacatggttcaaaaagaaagtttttgagaccatgggtgatgaaaaaaataatgaattaaacttaaaagataaagatcatgattatgatgataaatttattgaaaaagtatatgaccaaaataatgttgatgaatatatggtagatgttttaattcggagccgacatgctattcgtaatatttctgtcttaaatgttttaataaaaaagaaactgattgatgagcatcaaattcgttttaacgaagattttttctattacactgatgttccttttgtaatccaattagttaattacgcaaagagttttgatcgtgttgaacaagcaatttttgttaaaagaaaacataatgatccaatcaatacacctgctttatcacaaataaaagattctgaaaataaatttgatgaatttttgatggcttatcgctatagtgcttctttagtagctccagatagttatattcgttattatttagattcgaaaatgcttagatattacacaaagttttttgcacgaaagattcggcgcagtaaagatgatatttggcgtaacgaacgatttaaagcaatgggagaaatattaaaaaatattcatcctcgtttattgaataaaagttctcgttatagtaaaaaaatgatcaaagctggtctaaatggtgatcttgagttagcaaagaagactgtaagccggcatttagcaaaaataaagtttaaaaagatcttaaaaaataaaaacgagatgaataaatatttatatcgtcataaatatattaataaaccgcttgaagaaaatacggttatgtttgaaacttttatgggaaaaagttatgcagattcacctaaatatatttacgaatatttagcgaagaattatccaggtaaatataagtttatttgggtattaaatgatcctaaagaaaaattgccttacgaaggtaagattgtcaaaagattcacaagggaatatgcttattatttaggcgtttctaaatattttgtttttaatattcgtcagccattatggtttagaaagcgggaggaacaagtttttttagaaacgtggcacggaacgccactgaaacgtttagcgtttgatcaagaagaggttactgctgcttcgccgacctataaagctcaattttatcgtcaaaaacaagaatgggattatttgattgcaccgaataaattctctagtgatattttcaaaagttgttttatgtacgatggtaacatgctggaaacaggatatccaagaaatgatttattatcgttaccaaaccgtgatgcaatagctttagaattgaagaaaaaattagggattcctctagataaaaagactattttgtatgctccgacatggcgtgatgatgagtattatggaaatggtaaatataagtttaaattgaaattagatttagatttattaaagcagcagcttggtgatgaatatgttgtattgttaagaacacatcattatattgctgatgcattagatgttacgggactagaagagtttgcgtataatttgagtaagtatgatgatattacagaaatttatttaattagtgatatttgtattacggattattctagtgtgttttttgactatgctaatttaaaaaggccgatgttattctatacgtatgatttagataaatatcgtgatgtattaagaggtttttatattgatatggaaacagaattaccaggaccattggtttatactactgaagaagttattgataaaatcaagaatctgaatagtttgaatcaagaatatcaacaacgttatgaacaattttatgaacgtttttgttcatgggaagatgggaatgctgctatgcgagttgttgaagcagtttttaaataaggggtttaccccttatttttatgggaggaaagtaaatgaaaatattaaagaaactactcggtaagttaatcagaattttatatcgattcgtatatcgatttattccttgtcaggaaaaaacaattctttttatttcttttcatggtcgcggttattctgataatccaatggcaattcaccaatatctttcaaaacattcacaatatgctgattatcgttgcatttatgcaataaaaaatcataaacaaaaaaaattaaaaattgaaaatgctagaattattgagtattttagtattgcttattttttctatctagcgcgtagtaaatattggattgctaattgtaagctcccaaaatatgttttgaaaaaagatagccaagtttatttacaaacatggcatgggacaccattaaaaaaattagcacatgatattgaagttccagaaggaacaaccttttatcgtagtgaaatgagcgttgaagaaatgcgttcaacctacgataatgatgtaagtaagtataattatatgattagtcctagtgcttttacaactgaagtctttcaaagtgcttttgcgattgagagagagcgcttgattgaaacgggatatccacgaaatgatattttatcaaattataattctgatgatataaaaaaaataaaagataaattaaatttacctgagggtaagaagataattttatatgcgccaacttggcgtgacaattcatataatttaaaagggtatacatttaaattagaagttgactttaaaaagtggcaaaaaattctaggtacagattatattgttatttttaaaccccattatttaattgtaaatgattttgatttagaggcagttaaagaatttgtctactacattgatcctaaagaagatattagcagcttgtatttaattgccgatgtcttagttacagattattcaagtgtattttttgattatgcaatattaaaacgaccaatttatttttttatgtatgatttagacacttatcgtgatgagttaagaggcttttatttagatatttatcatgatttaccaggcgatgttattgaaagtgaggatgaattgatccaaaaaattttctctgaaaaatttgactataatcgattgcaaatatttaatgaacagtttaataatcatgaagatggcaatgcgagtaaacgggttattgaaattttattaaagtaggtgatgagatgggaataaagaaaattattattaatattatcttaaaaatagccaatatatttgttttaagatgttcaatcaagcaaggacaaatagcctttatttcattagagtcgaatcaacttgaaagtgatcttgaacttatttatcaggagttaaaaaaagaaaacaaatatagtttaaaaatggtattaataaattataataaaaaaagtttaattaacaattttttgtatatgttaaactgtattaagcaaatttatgtaattaatacttctaaagttgttttgattacagacaataactatgtaattagtaattttaaacgacctggcgttaaagttattcaggtatggcatgcgactggagcaatcaaaaagtttggaaatgctatcaaacgtgaatatcctattaaaaattatgactatgtgattgcaaatagtgattattggaagcagccttatcaagaagctttcaacgtttccgagcagggcgttattattacaggaatgccacgtgtggatcatcttgttgatccatattatttaacacaagcgaaagcacgtatgtatagtagatatccgattctaaaaggaaaaaaggttattttatatgcaccgacttttagaggaaatatttatcagggttttaaaacagttgactttgatgctcaagcagttttaaatgcactgggagaagaatacgtaataatctttaaatttcacccattgttattgaaaactacgctatcagacgattctagagtgattaatatgaatcatgaaaatactcatgatttattcgcagtttgtgatgtcttgatttctgatttctcatcaattatctttgattattccttattaaataaaccaatgtgtttttttgttccggatttagatgaatatattgaaacattaggatgttttgtggattatcgaagggtcatgcccggagcaatctgttataatgaaacgcaagttattgcagccttgcaaggtaataaaaaatatgatattaaggcatttagagatatgttttttaaatatcaagatggtcataatacacaaagaattgttatgtttatcgataaattaataaacaccaagaattaattcttggtgtttatttaatgattttcattcgccaaataatcacggacatttgataaattgtccatgatcttattagtcattatcgcaaacttatgatcagggtattttaaatcaggaatacaaattactttaatgcctgcactataggcagcgttaattccggattcagaatcttcgagaaccagagcttcatcgggcgtaattcctaatttttggcatgattttaaaaatacttcaggatcaggttttccttttgttacttcgtcaccacaaatggaatcatcaaaatatttttgtaaaccagataattctaaaatatgatcaacacgatgacgctgtgaactggttgcaacaattgttttatagtcgttttcttttaaatactttagtaactcaattaatccttcttttaaaggaaccccttcattttcaaataagtcagccatatattgatgaactgctttaattgtttcctcaacatcaaaatcgtcgccataatctttatggaaaagctcatagactgctttaacaggctttcctaaaagagttttataggcttctaatgacaatgttaaattatgtttagctaatacatgcttatatccctcgaatgtaactctctcactatcaatcattaaaccatccatatcaaaaattactgctgttatcatctttttacctccacgcaaatatcatatcataattatccgattagtaaaaagattttcatagaataaaaaaagttctaattcatatactgcactaaaggagttgtagatatgatacatagaggggaaatttattatgctgatttatctccggtagtggggagtgaacaaggaggatatcgacctgtgattgttttacaaaataataagggcaatcgatattcgacaacagtgattattgcgccaatttcttcacgattaacaaaaaatccgttaccaacccatgtgatggttgattgcagttcattggaaaaaaagagtgtagttttactagaacaaattagaacgattgataaacagcgaattaaagaaaaagttggaatgattgatagccaagtaatgaatctgattaatcaagcaattaagacaagcttggatattaaatagtttccttttgagtcagatatttgctataatagccccatggaggtagaggaaagatgaatgttcgtgatattaaattaaaggctaaaagtgttttagttaatcgtaataatatagttacagtatttgtgtttattagtgtaataacaactttggctaattatattggttcagaaattggcggggtgataccatttctttcattgattgtaactattataatgttgccctttggtcatgggaatgtggtaactgcattaaaaacagtcaatgaacaaggtgatgaggtcactattgaacaagatggggtagtcggattaagacgttttaaagatttatttggcacatattttattagagaaatattattattggtgattatgatgctgcttggattaatcatattcgtaattgctagatttacagtagacagtaatgttttttctcaattaggagcaattattgagcaagctgctgtatactctactaatgtaagtgcatatttaaatgatccaactgtaattgaagcattaggaacactaggagtaatcttttttattggtatcatcattattgcaattgtagcgtttatttatagtttggtatttgctttaacaccttttgtattagaaaaatataatatacgcggtgccaaggcaatgagtgaatcagctcgtttaatgaaaggacataaacgaactttatttatgctgtatttgtcatatttaggatgggctatcttagtattagtactttctgctgttgttgagatgattttaccgattccattaattttgaatattatcgtggcggctttgactacttatttgtttggtgctgaactaaatactagtttagcagtattttttgaagaaattgatttagaagataaaaataatatttaacgaggtgttaatttgaatttgataaaaaaaattaaattaaatagtaggcaaaaggcgataggggtcatattgatttttccctggtatctttattttgcaccaattgtaattaattattttttgaagctatatacagtatatatagctaatgatttttcaactaatagtttaaatgcattttttaatttattcatcggaattgcaactgctattcctttgattattgtgtttaagggttttattaaagaaaactggcttgtttttaaaaaagactttttggaaaatataatatgggtgcttacgatcgggattggtttagcatatttattttcaattgcaggggaactgattgtcaatcttgtagcccctcaatcaggcgaagcagctaaccagacattagtggaaactcttgtgcaatctaattttctattaatgttttttcaatcagtaattattgcaccatttattgaagagttgttatttagaggtctgattttcaacagtttacggcaaaaaaatatggtttgggctcatttgatttcagcattcctatttggcttgttacatgtttacagctatattttagctggtgatatgagtgaatggattaaattgattccatatatgatggcaggtttatctttttcaatcgtatatgaaaaacgtcaaacaattatagctccgatcattttacatgctgcaaaaaatctaatcgcagtattgttaatggcgacgatgttttaaacactatgcatgacatagtgttttttattgtgaaacaaaaaccacgtgctatgcgcgtggtaacaataaagctttagcgtctgggtaaaaaacctcctcgtgatataataattgtagcctggcagctgcaaataaaataacgaggaggttagtctatgaaagacacaaaaagtttatcacatacatcatatagatgtaaatctcatattgtaatagtaccaaaatttagaaggatggtaatatacaataaattaagacatgatataagattaattataaagaccttaattgaaagaaaaccgggaatagagctgatagaaggagagttatgtcctgatcatattcaccttctattagaaataccaccaaagtattctgtggcggagttcatgggatacctgaaaagcaagtcaacgcttatgatatttgatcgtcatgcaagtatggaatataaatatggaaatcgaaaattttgggcaagaggctattttgtagatacagtaggaaagaacgagaagacagtgagagaatatattcaaaatcagttggcggaagataagttgagtaatcaaatgagtatggaagaatttattgacccgttcacaggagaaccagtggaagggtacaagaaaaagaaaaaaagtaaaagaccctttgagggtcagtgagcaaatgacgttgcggttgtcaaggcgttcagtggtcgaatgactagcgcaacagcatgcccttacagggcgagtacgtcttttaggcgtggttatgattttataataaaaaaaccgtaaaacttatataaataagaattacggaaatttattaatggtctcccctcacggtctcgaaccgtggacccacagattaagagtctgttgctctaccaactgagctaaggagagaggacagatattataatacacctatttaaacataaaagcaagttaaatttaatgaaaaatgacattagctatgctataattactaggtgaatggagtgatctggcaatgttctacaaacaaactattaacaatataaaagtagttattttatcattggatggaggattattagatctaaatcggcttagatttaattattttaaaaggatttgtaaaactcacaattttgaattaactaaagatattttcgaggaagcccttggaaatatgaaaacaatgtataatgattttccaatttctaaagatattaatcccgatgatattaataagttgattgaacgtgatttatacgagtatgcaaagttaaagcctgagacaataaaaaaagagggaacggatgaactgttacaattttttaaacaaaaagagattaaaattgctgtggtttcaactcataaaacaaaacgtgcaattcaatatttacaattaacaagattgtatgacaaagttgattttgttattggcggcgatagcgataatctaccattaccagatactgctgttttaaaaacaactcttgaacaaatgaactgcaaaccaagtgaggcaattgtaattgcaaactatccaaatcttctttatgcagctaatcaatgtttaatcaatgtaatttatctaagtgatttatgcttggtacaagaatcgattggtccaagggtatttaaaattgcaagaaataatttagaaattattaatatttttctttttgcacgttacgatacaatggaaatattttcgccgttattagggatgtctagtgatatggatattgaaacactagataaaacatacgctaagctgcttgaagagtatcaaaatgatcagcagttgattgaactagttcgcaatacatatcattattttttgggagaaattgcaaatcgtgaagctgataccgtcaatacatcgttatttgaagatgaagatgttattgtagcgccagtggatgatgaacatttttctaatccccaaagtattgcaactttggaaaagtcaattgaagaggttttagagtcagaagaagtttcagaaactgacaacgaaattgccgatactgtttttaaaagagagaatttatatcaggatgatgaattttcaaaaacaagaacagcgataggatgtgatcctgaacgcgttaatgaattgatggatattattaatggtaattctggaactaagttggaagagggagaattatttgaaaagtcaaatgatgaaatattattagaaaaacggggactattgtcttattttattaattttgtctatactgttatcgtggtgggactgatatcatttttaggattaataatttttatcggttttgaagattttattcagagaccaggtattgttgctggaataattaaaagcattattgatttttatgttaatctagttttatccatatatgcggttatttttaacagcttaaatgctctactaagttttattcctgattattctagtttaattgcgggtaatggtttattatcgacaatggcagtaaaattagtattgttcattatttttaatgtaataatagtctatatagttaaaatgatttatttattaattacagaagcggaggaagatgatgcgaattttgcagaagattaaagaaatagatgttaaaacatcgcacttttttccgcagttttatcatcatcgtttttttagtggtgcgatgaagtttattgctggaattggtgattttggaatgatttggcttgttttaattttacttttaagtcttaatgataaaacacagctgctttctcaaaaaatgctggcagcgctaatattagcaacagtcatcggtcaagtgacaattaagtcgattgtaaggcgtaagcgaccatgtcatacatatcatgatgttgaaatgttgattccagttccgagtgattattcatttccttcaggacatactacttcaagctttgcatgcgcaacgactgtatgtttcttttttcctagagtcggctttatttgcatgatttttgctgcattaatggctttttcaagattgtatttgtttgtccattatttgagcgatgttacttttgcaattgttttgggaattagtgttggaataattgttatgttattttagtgtgataaaaggagcaagggtctgctcctttaaaaaaataaaaaaattattttttaaataagactgatttaaacgaaataatttgcttttttatcaggtagagtaagtttttatagaaaaaagttggctaaaattattgcaaaaactttttacatatgatattatgtttaagcaacagacggagacatactcaagaggctgaagaggcgcccctgctaagggtgtaggtcgggaaactggcgcgagggttcaaatccctctgtctccgccattatattggtctggtagttcagttggttagaatgccgccctgtcacggcggaggtcgcgggttcgagtcccgtccagaccgccaattagattgtttagtttcactttggtgaaactttttttataaaaacaaatcattatgatttgtttttattaatataagcatgcaaaattgcaatcattgttttagaatcaaagatttcgccattaactactttgtgataagcggtatcaatatccattttaattaattcaattacttcatcttcatcacactctaaaggattttcgactttgtaaacatcatgagcttcgtatacataaagccattcatcactataaccaggagttggtaaaaacttagaaattaaacttatctttttagcactatagccagtttcttcttctaattctcgtaaagcgcatatagcagtatcttcatttaattctaatttacccgcaggaatttctaaagtatctacagcattaggataccgatattgctttactaataaaattttgtcatcaacaatagcaagaacgccaactccgccgtggtgtcgaactacttctcgagttgcgagattcccattttcacattctactttgtctttataaacagtgataatttttccatcatagattatttctgatgatattttcttttccattagtttcacctcattaaaagtataacaaaaaaagtatgcgggggtgcatacttttttctattatttcacgtaagggtgataatagggggtatgtaaagcgaaatacttcacttaacaaagtcaattatagcatcagtttcataaaatgtaaagggttacaataaaagtattaggcgtttttagcaaattttgttataatgtttcaaggtgatataatgaaaaaattaaaaataacagaaaatgatgctaatcaaagaattgataaatatttaaaaaagttactagttaatgctccaaataattttatatataaaatgtttcgaaaaaaagatatcaaagtaaatgggaaaaaagtggatgaaaaatatattttatcattagatgatgaggtcgaaatgtttttatatgatgataaattcaaagaatttacagaaaccaaaagtatctatgaggttaataaaacgtttagtgttctttatgaagataaacatgtattgattgtttttaaaccagcagggcttttagttcatgaggatgcaaatgaaagcattaatactttaacaaatcaggttttaagttatcttgcttcaaaaaatgaactagatctaagtcgagaaaatacttttatgccaggaccagttcatcgtttagacaggaatactagtggaattgtaatttttggtaaaactttggcagctttgcaaaatctcaatgaaatgataaagcaacgtcattgcattgaaaaaaaatatttaacgatctgtcgcggacaattgaatcatcagcgaaatttacacggatatatgatcaagttagagaatcaggctcaagttaaattagtaaagaaagactatcctggggctttaacgatggaaacgattgttaggccgttaaaatataattgtgattatagtcttgttgaggttacattaataactggacggatgcaccagatcagagtacatttatcaagtattgaacacccaattattggtgatcgtaaatatggagattttgaactgaataaatatattaagaagacttttggtttaaataatcaattgctgcatgcttataaaataaaatttgtaaaaacctttggtgtactaaattatcttcaagataaagagataatttgccctgtgccggctttgtttgaaaaaatagagaaaagtttgttatagacacctttaaataaagagttgtttattgtataattatttacatagattataggaggaaagatatgaaatactatattggaattgatttaggtgggactaatgttcgtactttgctggtggatgaaaatggtaaaacttatagtgaagtaaaagataatactgaaagagaaaatggtcctgactatgtatgtgctaaaatcattcgtcaaattgaaagtttagatacatcaatttgtggtggtttacaaggtgtaagtggaattggtattggggtacctggacctgttgacacagtaaaaggtacaatgatcatggcaacaaatttacctggattcgaaaattatccaatttgtgataaattagcagatcgttttaatttaccaacttttattgataacgatgcaaatgttgctggattagcagaagctttattaggtgctggaaaagattatccgacatgttattatgtgactatttcaacaggaattgggggagcctttattgttgatggtaaattagtttctggtggtcgaggacatgctggagaaattgggaatattattgttaaaaacaatggttataaattcggaggtttaaatccaggggctgctgagggagaaactagtggtactgcaattactcgtaaaggtaaagaacttttaggagaagatagagtaaatcatgctggagatgtttttagattggctagcgaaggtgatttaaaagcacaaagtatagttgatgaatgtatttcagaattagcaacaatgtttgctaatattgctcacactgttgatccgcactgttttgtaattggtggtggtgtaatgaaatctcgtgaatatttctatgatcgcttagtagaacaatttaactcaaaaattcatgtaggaatgcgcggatatattccgttattaggaacaaaattagaagattgtggagcaatcggagcagcaatgttaccaatgtcaagattaggttaagaaaggatatttcatcctttttttttgatttaaagtagtagttttttaaatcgaataatggtattatagtacggtgaggtgacgagaatgtcaaaaagagtagtattaggattaagtggtggtgtcgattcagcagttgctgcttatttgttaaaagaacaaggatatgatgttattggtgtgtttatgcgtaattgggatagccagttaaataatgatattttaggtaatcctactaatgataatgatatctgtccacaagaagaagattataatgatgccaaggctgtagctgaatgtcttgggattcctattaaaagggtggattttatcaaagagtattgggatcatgtatttacatactttttagatgaatatcgaaaaggtagaacacctaaccccgatatattatgtaataagcatattaaatttaaagcttttttagattttgctaaaactttaaatgcagattatattgctacaggtcactatgcccaagttaaacattatcaaggagcagattcggtgatgttaaaaggccttgataataataaggatcaaacatactttctatgtcaattaaatcaacaacagctacaaaactcattatttcctttaggtgaaatagataaaacagaagttcgtcgaatcgctagagaattgaacttaccagtagcagataaaaaagacagtaccggaatttgttttatcggagaacgtgattttaaagagtttttacaaaattatattccagctcaagctggaaaaatggttgatatagaaactgggaacgtgattggtgatcattcaggaatcatgtactatactattggtcagcgtaaaggattagggattggtggtccaggtgatgcatggtttgtcgttgggaaagactatgataaaaatgtgttatatatttgtcaaggagatcaaaaagattggttatattcaaccggggctctgattactgatgtgaactggattgcttcaactaaaccaatagataaaattgcatgtaacgctaagtttagatatcgtcagccagataatccaattcaacttgaatttattgatgaagatactgtttacttaacttttgataaaccaataaaagcggtgactccaggccaagctgcagtcttttacgatggtgatatttgtcttggtggtggaacgattgaaactgtctataaagatgggcagccaatcaagtatttataatgattgaatatacaggttatattaagaagattcgtttttatagcgaatcttctaattatatcgttgctttaattgaagttgagcaggaagataagttgatcacaatgaatggttatatgaataattttaatgattatgaaaaatatgcttttattggtgattacgaaattcatcctaaatatggtaaacagtttaaattatcagaatatcgtatcatttatgcaaaagaaagtgaagaaattattaaatatttatctagtccgctatttaaggggattggtaaagctttggcaacacaaatagtaaatacacttggtgaagagtgtcttgaaaagattaaagaagataaacataatttagatttggttagaggaatgactgaaaaacggcgggaaataatttatgaagcattgactaatggtgattatgatcaagaagtaatgcagttttttatgggacatggtatcagtctgaaaaacttgggcttgattcaagcatattatcaagaaaaaacattagaaatacttcaaaacaatccgtaccaactagtagaggatattgatgggattggatttaaaacagctgatgagttagctttaaaaacaggtgggacacttgataatcctaatcgaattaaagctgggattatttacagtattaagcaatatgggtttaatactgggagtacatactgttaccttgatgaaatcaaaataatgttttctaaaataatatataatattgaagaagtatcgtttaatgaatatcttgatgaattgattgatgaaggattgattattcaacgtggtgataagtattattattttgaaatggatgaggctgaaaaaaatatagctgaatatttaaaaatacggataaataaacccgatgaactttttgatgaaaaagaagtagaacgattgttgacaaattatgaaaagactcaaggtatatgttatgctgccaagcagaaagaagccctaaattattttttaaagtcttcttgcatgattttgacaggcggacctggaactgggaaaacgacaattgttcaagcacttttaaaagtgtattcggcattatacccagatgatcgaattggtttagttgcgccaactggtcgggctgcaaaacgattgacagaattaactggaatttatgcttgtacaattcatcgcctattaaaatgggatcttcatagtaacacatttgctatgaataaaagcaatccattagatttagatgttttgatcattgatgagttttcaatggtcgattgtttattgttgagtaaactttttgaggcgggtcgaggaatcaataaagtattatttatcggtgattaccatcaattgccttcggttgcacctggaaatatattacaggatttgatggaagctggagtgaaaacgattgagctagatgaaatcttcagacaagctaaggattcaggaattattcaattggctcatcatattattcataatgaaattgaaaatatggatctttttgagcaatatcgggatataaacttttttccttgcataaactatgatgtcgtaaaaaatgttaagataatagtaaaaaaagcaattgacgaaggttatgacacaaatgatattcaagtactagtaccaatgtatcagggagtggctggaatcgatgctttgaatgatgctttacaagatgtttttaatccgattgatgaatttaatgattcatatcaaattggccgcaaggaatatcgtgtaggtgacaaaattttgcagttaaaaaatcgacctgatgatgatgtttttaatggtgatattggaacgcttgttgaaatatgtcgaaaagataattttgaatatttgcaagatacactgattgttgattttgatggtaattttgttgaatatacaagtaatacttttaacacaattactcatgcttattgtatgtcgattcataaatcgcagggaaatgaatttaaaatcgttattatggcggtcttgtctgattattatattatgctacggcgtaatctattatatacagcgattacaagagcaaagcagtctctctttattttaggaaactctaaagcttttatgcatggtttagcaaattatcaagacagtcgtcgaaaaacaagcttaaaaagtcgttttaaaacaattgaaaccttaaatgtgtatgattttcttgaataaaggtaaactatactgaggtgagatatatgatgacaagaagcaaaatactaattggattaacagttgcatcactaatgattttgttgagtgaatgtgagtgtgttgaagatatgatgtatgaactcaaagcaaagatgtaaagatataaattaatagtcttgaaaaatataattggatagtttataatttggtaaatcgttgaaaaagaaaagtactataaaatagatctttcagagaaagtatggctggtgaaaatacttatcattttataggaaagctactttggagagtaattaaagattaccgtgtaggctacgttaccagtcaagtaagggcatgagttttcatgaactaggatggtaccgcgattaaagtcgttcctagcaatagggcgactttttatattgtaaaggagaacaagatgaaacaattaacaggaaatcaagttagaaaaatgtttttggatttttttgaaagcaaaggtcataaagttgaacctagccactcattaattcctaatgacgatccaactttattatggatcaatgctggagtagcagcaattaaaaaatattttgatggaacaataactccagataatccacgaattacaaatgctcaaaagtcaattcgtactaatgatattgaaaacgttggaaaaacagctcgtcatcatacattttttgaaatgttagggaacttctcaattggtgattattttaaaaaagatgcaattgattttgcgtgggaattattaactgatgaaaaatggtttgcttttgaaaaagataaattatatattacagttcatgatcatgatgaggaagcttatgactattgggttaatgtcaaaggtgttgctgttgatcatatgttaaaaacaccaggtaacttttgggaaattggcgagggaccatgtggacccgattcagagattttttatgatcgtggggaaaaatatgatcctgatggtttaggaacaaagttgttttatgaagaattagaaaatgatcgatatattgaaatttggaatttagtattttcacaatataactcacaagaaggagtagctcgtgaagattataaagagttgccacaaaaaaatatcgatactgggatgggattagaaagaattactagtattattcaaggtggagaaacaaattttgatactgattttttcttaccaattatccatgaagtagaaaaattagccaatgtttcatatcaagaaaataagatggcttatcgagttattgctgatcatatccggactgtaacatttgcacttgctgatggagcattatttgataatgcaggtcgtggatatgttttgaggagaattttaagaagagctgttcgttatggtaagcaaattggaatcgaaaaagcgtttatgtatgatttagttgatgttgtaagcgaaattatgaaagaattctatgattatctaccagaaaaagtaagttatattagtgacttagtaaaaaaagaggaagaagcttttcataagacgttaacaaatggtgaaaaattattaagtagtattatcgcaaaaaatactgatggtgtgattagtggaaaggatgcctttaaattatacgatacttatggttttccttttgaattgactttggaaattgctgaagaatcagatttaaaagttgatgaagaggcttttagagcagagcttaaagtacaacaagaaagatcgcgtggagcacgtactgatagtgaaagtatggcaagtcagaaacctgatttaatggcctttgatttaccatcgaattttgaatatgatccaacaaatatcaatagtgtagttattggattatttaaagatggtgttaaaacagatcgaattgatgattatggagaagtcatttttgatacaacaactttttatgctgagatgggtggtcaatgtgcagatactgggtatgtttataatgaaaattgtcagggtgaagtaattaatgtgctaaaagcaccaaatcaacagcatttacatttcgttaaattgaagacaggaacgattcgagttggtgatattttaactttagatgttgataaagctaagcgaaataagattattgctaaccatagtgctactcatattcttcaagcagctttaaaagaaattattggaaaacatattaatcaagctggttcttatgttgatgatcatcgtttaagatttgattttactcattttgaaaaaataacaaatgaacaacttaaattaattgagaatcaggttaataatgtcatttttgatggagttgctgtggatattgcacacatgactaaagatgaagccattaatagtggtgctatggcgttgtttgatgagaagtatggcgataaggttcgggttgtttcaatcggtgattattcaatggaattatgtggtggatgtcatgtttcaaacagtgcaaatattggattatttaaaattgaggctgaagagagtgttggtagtggagtgcgtcgaattgaggcggttactggaaagactgcttatcaagcgttagttcaagaaaaagaaacggttgatattattagtaatattttaaaacttaaaaatcgtaaagaagtagttgcaaaagttactgcattaactgaagaactttccaacactaaaaaagagattgaaatattaagcggacaattaaatgcgctaaatgcagcaagtaaagccaatgatattcaagaaatcaatggagttaaagtgttgtttgtagaagaaatgattgatgctgctaaagcgaaacaacttgcctttgattttagagataaaattgaagaaggaattgtaattttagtaacacaatttgaggacaaatgttcatactttgtcggggtgactaaaaattatgttgcaactggatataaagctggtgatattattaaaaaaatcaatgcagttgttgatggtcgcggtggtggaaagccggattttgctcaaggtggctgcccaattaatgataagatttccaacatcaagggagaacttaaaaatttcttttaatttctaagtaattggtgtaaaataattctataggcaaagccttaaaggaggtcgaataatatgcaagacttaacaaagacaaaagtattcagttctgaagatatgcgtcgtgagatgattcgtcaaaatcttaaaacagtaattgatgcattaaatgaaagaggctataatgcagtacatcaaattgcaggttatttaatctctaatgatcctgcttatatttcaagtcataaaaatgctcgaaatataatccagcaaattgaacgtgatgaaattattgaagaattagtcaaatcatatttggagaagtaggatggaacggatattagggttggacttaggttcaagaacctgtggtattgcaatcagtgatactttaggcatgttagctcatggaattgagacttaccgttttcgagatgatgattatgatagagccgcaaagcacgttgttgctttaattaatgaacatcagatcaaaacggttgtacttgggctacctaaacatatgaatggtgatttgggtgagcgtgcacaaatatcaatcatgtttaaagaaatgttagaaaaagaagtaccgggtctcaatgttgttttaattgatgagcgacttacaactaaagtagctcaagatcaacttatctttgctgatgtttctcgaaagaaacggaagcaggtaattgacaaaatggctgcagtagcgattttacaaggctacttagatgcccaatagaaaggaatttaaatggaagcaaataaaatccaagtgatcgatgatcaaggtaatgaaaaagaatttgaagtattatttacttttaataatgaggaattaggaaaacaatatgtgttgtattatgatacaacagttgaagaacctagtgtatttgcatcaatctatgatgatgctggacaattattccctatagaaacaccggaagaatgggaaatggttgaagaagttttccaaagttttatggctgaaagtgaagaaggtcatgaatgttgtggaaaccatggaaatggatgctgtcatgataatgatgaagaacatgaatgttgcggtaatcatggagactgtaactgcgataactaataaaagctaaattatttagcttttttctcttaaactagaaaaggtggtatagaaatggctttaatgggattatttggaaaaaaaagagttactgaatcattttttgtcaattcatatggaaatgatcagacacgtggtatttatacatttcaagtagatattgaaaatggagaaatactttataaaaagcattttaaaacaccctcagaccctgtctatagctttaattatgggcgctttgtgtgtgttacatataaaaatagaacaggtacaagtggtgatggtggaatttgttcatatgcagcaactgctgatattttagcattagtatcgcgaattagtgataaaggtaaaacatatatgcatgcttgtgctaatggtgatcatgaaacagcagataaattatatgctgttgattattataacggtgagatcatggtggcaaaaattgataagaaaaaactagttgcacctatttttaattataaattggaaggacatagtatcgatccaaaacgtcaaaatcaaccacaccctcattttgtcgattttactccggatggaaaacgtttaattgttgttgacttaggattagataaagtactgctctttaaaatggaagcaaaggagattattttggatgaagaacattcatttgatttagaaccaggatctggacctaaaaagattatgttcaaccaggctggaacaatagcgtatgttttaaatgaattatctaatacaatttgtgtttacaaatataatgatttgaaatttgaattaattcaaaccatcgatacatatccaaaagatgaatatgatgagcctagcttagctggacaaatgctttttagcgaaaaagaggagcgtatttttgttactaatcgtggtcatgatagtttagcattatttttagtagatcaagaaacaggtttattgacttataaagattttgttgatacttcaccaaatgctcgtgatattgcaatctttaaagatcgttggattgttgcagtttgccaaaagggtggagtagttgaaagttatgaataccgcgatgagagaggcggaatgctttttgaaaccaaatactcatatctagtcagtgagccggtttgcattacaaaatttgagactatttattagagatgattattcatctctttttttggcataatatactgacgaagcatgttttattatcggtagataagttgaataagcgctaaaaatatcatataatggttaagacggaggagaatatgaaaaaaactcagaaaattattattggagcaattgctggaataacgattgttgtactagctttagtgtttttttatttcaatggccaaggtgctgtttcttctaaaagtgaagaggtagtagttgaaatatctggatcaacatcttcggtcttaaatcagcttgataaggcaggtctattaaaaagcaaaacagttgctagtatctatacaaagtttaatagttatagttttaaagcgaatgtttatgttttaaataaaaatatggatttaaagaagattcttacaattttggaaggagataaggattatatatctgctgctaaaattacgatattagatggataccgtatacctgaatgtgctcaacaagtagcaaagggattagaaatcgatagtaccgaggtattagagaaatggacaaataaagaatatttgcaaactttagtggaaaaatactggtttttggatgaaagtattttgagtgctgatattatgttcccgttagaagggtattttggtccagaaacatatgtaattacttcaaagaagacatcgattgaagatgttacaaagatgatgctggatcaaatggatcgtaatttaagtacttataaagacaaaatcagtaattttatgattagtggtaataaagtatcgatgcatcaatttttatcattagcatcagttgtacaatgtgagtcatctggccaaaaagaagatcaggctaagatagccggtgtctttatgaatcgtttggaaaaaccaatgcgtctgcaaagtgatgtaactgtaaattatgcaaatcaaattaaaacggtagcagtaacgtataatcacttatcagtcgattctaaatataatacatataagtatgaagggttaccagtcggtccaatcagtacagtttcaacaaacattattgaagcatgtctgaattatcaaaagactgataatttgttcttctttgctttgaaagacgggtcagtcatctattcaaaaacatatgaagaacatcaacaagtagtaaaggaaaataaatggtattaaaatgagatattatgaaaaaatagaagctgatgctttagcccgaaatatacctgtaatgcagcgtgaagggcttgaatttatgattgaaatttttaaacatcataattgtcattgttgtttagagattggtagtgcgattggatattcagcaatgatgttggtaagtaatattaataattttaaggttgaaacaattgaattaaatgaggaacgatatttagaagctgtaaaaaatattgaagaaaataatttaaaaagtcaaatcattattcatcatggtgatgctttatcatttgatttagagcatttgaaaattaaaaaatatgattgtttgtttattgatgcagctaaagcacaatatcaaaagttttttgaaaaatatatgcctttagtggcagacgaaggtatttgtattgttgataatttagattttcatggtatgatttttgatattgataatataaagaatcgaaatacaaaacaactggtaaaaaaaataaagcgttttaaagattggatctttgataacgaactttatgatgttgaatatcatcatgttggtgatggtatttgtgtgataagaaaaagggtggcacaatgaagttagtattatctttaaatagcaaaaaatttatttatgattatgtggatattggtgttgaatattttgtcgttggggcaaagtatttttcatgtcgtcaagcattatcgcttgagtatgatgaaatcgccaatttaaaaaaggtcctaggtgataaaaaagtatgggttttagtaaatgcactagttgaagaaaaatatatcgatttcttagaaaagcatttaattagattgagtcaaattggagttgatggaattttatttcaagattttggtgttttacagatttgtaatgagcataattttgattttgagatgatttatcatccagatacattaaatactaatcaagcaactttaaattacttgggaactcaaggtattaatggtgcttttttggcacgggagataccgcttgaagaaaaaaaaataattgctaaaaatgttaatgttaaaacaatgattcaagttcatggtgttgaatatatggcatattcaaaaagaaagctattgactaattattttaaggaaatcaatcaggatattccaattggaatatcagatgatctgacgattcaggcaaatggtgtaaattatagttgtcatatttatgaggatcaatatggatgtcatattttgagtaaacagcaaatgtgtggcttagacataatgagtagttttcaagattttgattacctctacatagaatctttatacgtcgatgaattaaagttagtagaaatcgttaatttatatcaagatgctttaatcagcgttggaaatagaacttacggaaaagtcgctaaggaattaatatcgcaactttatcaactggatccaaatatcgaatatcatcatagctttatgtttgatgcaactgtttataagattgatgatgtaagaaagcgggaagaaaatgagaaatgtaagtaaagtaattaacggaaaaagggtaataataaaaaaacctgagttattggcaccagctggtaacttagaaaagctaaaggttgccattcaatatggtgctgatgcagtttttgtgggtggaaaagaattttcattacgttctggagcctcaaattttacacttgatgatattaaagaggcagtaacctttgctgatcagtatggcgctgcggttcatgtgacatgcaatattattctacatcaagataatcttgatgggattgaagaatatctgcgggctcttgatcaagcaggtgttagagcgattattgtggctgatccatatattatgtcaattgctaaaaagttgaatttaaaattagaagttcatgtttcaacacaattatcaactttaaatacaaaagcaattaaattttatcaaaatttaaaaatggatcgagtagtgcttggtcgggaagtttgttacgatgatttgaaaactattttagataaaactgatgtagatattgaatattttattcatggtgccatgtgtattcattattcaggtcgttgcatgttgtctaattatttttcacgtcgtgatgctaatcggggtggatgttcacaatcatgtcgctggtactatgatctatatcaaggtaatcaaaaaattaatcaagatggtgtaattccttttagtatgtcaagtaaggatatggcattaattaatcatattcctgaattgattgaactaggagtcgattcttttaaaattgagggtcgaatgaagtcattgcattatattgcaacaattgtttcgacctatcgaaaattaattgatgattattgtaatgatcctgataattttgaattgactgagaaatattatcgtgaaatacaaaaagcggctaatcgttccttatgcactggtttctttgatgatcaggcgggtaacgataagcagttatataatcaacgtgatgaacatcctacacaagaattttgtgcccgagtaatcagctatgatcaagttaatcaaatagctacaatagaacaacgtaactattttaaaattggtgatcaaattgagttttttagcccatatcacgaaaatgttgttgtgccagtaacaaaaattataaatgctgataatgaagaagttgaagtagctaatcatccaatggagattctacaaataccggtcagtgttgaattacaaaaggatgatatgggaaggaaagtgatttgatgaaaaagccagttattattggtattgcgggaggtagtgcttcgggaaaaacctctattgcacaagagctttatgactgttttaaaggacgccatacaattagaattattaaattagatgactattataaagatcaaacacatttatcaatggataaaagagtcttaactaactatgatcaccccttagcttttgatatggatttattgattgaacatcttgatttattaaaagaagggaaaagtattcaaaaaccgacttatgattttgaacagcataatcgtagcaaaatagtagaaatagttgattgtcgtgatgtttttattcttgaagggttatttgtgttaaatgaagtacgaattagagaacgctgtgatattctagtatatgttgatacagatgcagatattcgctttattcgtcggttgagacgcgatcttgaagaacgagggcggagtctagattcggtatgtacacaatatttaacaacagtaagaccaatgcacgaacaatttgttgaaccatcgaaaaaatatgctcatattataattcccgaaggaagcagcaacactgtagcaattgatttattgttaacaaaaatatcttcaatagttgattagtgaagatattaggactagatatttatatagaattatgctatattagagactacgaggtgatattatggaacacgaaaaagtattgttaacccaaagtggggtagaaaaattagaacaagaaagagataacttgattaatgtcgaaagacctaaagttattgaagaattacaattagcacgttctcaaggtgacttatctgaaaatgctgactacgatgctgctagagaaaaacaagcacatttagaatcaagaattaaagaaattgactatatgcttcaaaatgctgaagttatttctgaagaacaaatggatctaaaagtagtaaaacccggtactactgtaacaatcttagatttatcagaaaaagatgctgaacctgaaagttaccaaatcgttggatatactgaaacagaccctttaaatggaaagatttcaaatgaatctccattagcaaaagctgttttaggtcatggagtaaatgaaattgtaacagttggggttgcagatccttatgatgtaaaaattgttaacattgagtttaaaaactagaacttataaaatgaacctactatttagactgcaaaataagtaaggttcttttttataaacaattttaataagtagaaatagaaaaagaatgatttaatcagtattttgtaagaactgtttaaatcattctttaagggaaattatctttggaaagatgaaatattctatggatttgtatataaagttgattaactagatgattggtatatgaggtaattaaagagattgccacctgtataataacattatcattacggattgattatgccaagatattaagcgtctaatttttttgtatataattgtaaaattaaggtagtgataattaaaatgattggtcttgaaaggatattaattagattaatgtcttcaatatttaccattaatgcgataattccaaagatcaatccacatagtaaagcgtgaataattgctttattttgaaatattttgattagccaaaatgcccatacaatcataatgattccagcaattatattaataatactatggtagataaaatttgataaatgaataaaacttataattccggccatgataagactagtaatagtaaaggtgataaggataaataaagcgaattttaggtatatttttaaatatgatttcatatttcctccttgttatcttactaatattatatttaaggattggtgaaatatgaatatcttcgatgtatttttaattagtgtttgcatttatatttatttaagtatcttgttaagaatttttggtaaaaaagaatttagtcaattaaatgtatttgattttgtagtatttttaattattgccgagatcatgacagatacgataggaaacagcgattttactttttatcatggtgtggttgcaactgttacattgattgttgtagatcgacttgtttcaatgataacaatgaaatcaaaaaaacttcgcgatatttttgaaggacgacctacatacattatttttaaaggaaaattggatcaagaaataatgaaaaagcaacgatatactgttgatgatttatcacatcatttacgagttaatgatattgatagtatttctaaagttgaatttgctttattagaaacaaatggttcactttcaattattcctaaagatcagtgtgtagtagaattaccggatgctttaatctgtgatgggataattgatgaagataatttaaaattgctcaaccgggatataaattggttaaaaaaagagttgaaaaaacaaggtgtagataaaatagaagatgttttttattgtgtgccagaaaagggccacttattagtaataaaaaaatagagctggaatcagctctatcctaatagcatgcgatcgttgtcaaattcactaccgcttgcttcttcgaattttttaagtaaatcatcaactgttaatttggctttttcttcaccgttgacatcataaataatacggcccttgtccatcataattaagcgattaccgatattaatagcatctttcatattatgtgttaccattaaagcagttagcttttgttcagtgacgatttcctctgttaaatcaagaacttttttagcggttcgaggatctaatgctgcagtatgctcatcaagtaaaagaattttgggtttttgaagtgttgccatcagtaatgttaaagcttgacgttgtcctcctgataacaaaccaactttacttgacatccttgtttctaaacctaagtctaaacgttttagtgcttcatgatattgttttttttcttctttgctgattccccagcttaaaccacgacgtttaccacgacgaaaagccatagccagattttcttgaatttccatattagctgctgttcccatcataggatcttggaaaacacgtccaataaatttggcacgtttatattcatcggcgagcgagatgtcttgattgtcaatagtaatatatccacagtcaattggataaaccccagcaatcatatttaaagtcgtacttttaccagccccgtttccaccgatgattgtaataaaatctccatcattaatagtaaggttcaaatcttgaagagcctttttttcattaacagtaccaaggttaaaagttttacttacatgttctaatttaagcattctctttctcctttgttaattttttgtatgtagcaatttgttttcttttacttaccataacaggtacagttaatgctatacctactaataaagctgtcaacagttttaaatcatcagtacttagacccaattgtaaaacaactgcaacaataatacgatacaaaattgaaccaacaataatagcagttaaagtaaacatgaaaccaggctttcttcctagtattacttctccaataacgattgaagctaaaccaataacaattgctccaattcccatcttaatgtcggcataaccttgagattgggttactaatgcaccagacattgctattaaaccattagaaatcattaaacctaataatttagttgtatttgtattagcaccaagtgctcgaaccatatgttcattatttcctgtagcacggatagcactaccaatttcggttccaaagaaccagtaacatattaaaataacgattatcgcacaaattattccgatgattaaagtaatccatgcttgtgatagattgaaagtatttgataaacctttgaagatagtatcactttgaagtaaaggtgtattactttttcccatgattcgtaaattaattgaataaaggccgatttgggtcaagatacctgctaaaatcgcaggtatttgacatttagtgtgtaatagaccagtaatagctccggcaacaaatccagcaattatagctaataaaacagcaagaataggatttattccattgacaatagcaacagcacaaacagcaccgccagtggcaaaactaccatcaactgttaaatcggcaaaatctaataatctaaaagtgatgtagacccctaaagccataattccccaaaggattccttgtgatgctgcaccttgaatagctaagataaaactcattacttattcaccatctttgctttagatttaagatcatcaggaattgtaatgtttaattttttagcaactttctcatttattgttaattcacattcttcagcaggtaaatattcaattgccatatcagcaggtttagcttcgccctttaaaatttttacagcctgaagaccagcacgatatcctagattataataatcgataccataagtggctaatcccccattttcaaccatcccactttcaccaacaatacatggtaaattgttttcattagcaacttgagcaacggttgccataccttcggctaagagattgtcagttggaatgtaaatagcatctacttttccaattaatgactcagtaacttgttgtatttgattagaatcagtaacagatttatcaactacagttaaattacgtttagcacattcttctttagcaatgtcagcttggaaaattgagttatcttcggcattacaatacatgatcccgattgttttggcatcaggaagtaattgttgtaacaaatcaaattgatcagcaaccggtgttaaatcacttgtaccagttacatttccgccaggtttttcattggtttttactaatttagcactagcaggatctgttacagctgataaaacaattggaatttctgttgttttgtttgctgctgcttgagcagttggtgtagcaattgcgaaaatcaagtcaacgttatcgttaacaaatttatcagcaatggttgtacaatttgatccatcaccttgagcattttggtcatcaaatgcaacattgtcctcaccatagccattgtcttctaatgctttcaaaaatccttttttagcattatctaatgcgggatgttctgcgtattgaacaatgccaatattaacatccttacttcccccacaggcacttagagttagtgccatcattacagttaaagatgcctttaataattttttcatatttattccctccatattttcaattattaaacaaaaagtcgccctcgatagaggacgacaaagtcgcggtaccaccccaagtttattattaactcacattaataatcttcataagtgtaaaactttactacgataacggctagccaccgatgattacctacttatcagtatccgactccatgatgaattcaatatttcttaacgtattgttcgcaccaaccacaatatctctgatatctaagtcatatttactacttcacttcactgtctttgtttaatagattgttacctaaaataatacgttatgaagttctatttgtcaatataataaaacttgtaaaattaggataaatagctttatttctaaaaaagtattttttgtttaggatttaaacaaattaaattactttaaatagtatttatgataaaagaatgtctaaagacatcataatgacaaaaccaatcatgaaacttattgttcccaaatcaattccttcagttgcattagcttcaggaattaattcttcaatacagacaaaaaacatggcaccggctgcgaaacaaagagcgaatggtaaaactccattgactagagtggcaaaaataaagcctaataatgctgctgggatttcaacaatagcagaaaattgtccatacatcatggcaataaaacggctttttccgcattgatgcataggtaaagaaatagcagtaccttcaggaaaattttggataccaattcctagagctaagattaaagctggtaagtaatttccatcgtgacatcctgcaaatgccacaccaactgctaaaccttcaggaatattgtgtaaggtcatagctaacattaatagcttgttttttgaaaagcgacctggattgattccttcttgttcatgtgacatcatgtgttcatgggggagcagtttatcaatcaacatcaataatgctacaccacaaataaaaccaaatggaatgattagtaaatcaagtttacctccagcttcaagctggtcttttgctggaagtaataatgaaaaaaatgaagcagcaaccataattccagcagaactgccaagagcaatacaaatgagtttttgactggctttgcgaacaaatagaactaacgatgctccaaagaaggtcattaaccagttaaatgttgctacaattaatacaattataaatggatttaacgataataaatattccattttttcacctcaattattactatgcataaaagcctattgcatatgggcatataagttgctgatgaagtaatattatgatatgattattcttaatgaggtggaacaaatggaagaaatgtcaattgcgatgcaaaactatttagaattaatttatgaactttcattagatggaaaaaaagctagagtcagtgatatcgctaagcatttaggtgtatctaaaccaagtgtcaataatgcagttgtggttttggctaaagatggctatgttatatatgaaaagtatgcggatgtaaaactaacgcctaaagggaaagaaacggctgagtttatctgtggtaaacatcaaacaattaaacaattatttgttgaagttttgaacatagacgaaggaattgctgataaagacgcttgtttaattgaacatgtgatttcaaatgagagtattaaagcaatgcaagaatttttagatagacaaaaataatggttattaggaagtttcctaataaccattatttaatatccaaaatccagatattcttcagtagtaataattaaaatagctttatttgtaatttcgtttttcttgttgtcaaatgtttcaattggggtatattcaactttatcacgacgttgaacatcttcatcgtaaacataatcggcttgtctaaagaaaataccatcttcatcataacgcgagatagtcccaagaccacgctgattattataatgaacaactgttccttcaacacgttctacatatttacctaaattattcattactttttcatataattcatcatataattcttctgatgtttgatcgttatatttttcaccataatcagcaactggagtatattcacgattattttcagcagttaattttgttaagaaagcatctacaatttcaattaacatcgggtcttcagtacgttgtgtagcctccatcaagcgtgtataaattcctaaatgattaattgaatatccattttcaaaaaattcatatagtaaataagcatttgcttctttaatgttgcctgtttgagcattagttttataaagaacttcgtagaaattaacattacggattcggttatgtaaagataagaatacttttttagcttcatcgtattgttctagttcgactaatgaacacgctctttgataattaatccattgcaatgtattaaaatgccattttaaagatagagatagtgcattgttagcagtatcaacacattcttttgaacgtttggcctcgtatagagcttttacttttaatcgatagtagcgttcttttttagattcaaattcttttccttcatcattagtaaatggtttatcatctaatagattaggatcaagtaaatcaagcatttcaactaatttgttaggatcttcaggtttttcacgttgtaaatatttaatagcacgatttactgaaggttccattggagaataacgttcctgtttgcatacagctaaaatatcttttaagacactaaagaaaagatcttcattatctctaattttttcatcatcaatattgatgaacttattataaagtgcatacccatattgattcagatatccgcgaagatttggacataatgacataaatgtctttccaacctcaattgcctcttcattgttgtcgcttttcttcaatagtttaatgtaatcattggcctgaaaatcattgaaggaagttgggtcttctttaaacttttcattgtatacttctaaactttttaattcattttcattcataaaatcacctctaatcaatattatagcatctttttaatctcttttgcagtagttaagtaataaattgttttgaaatgcaaatttatatgttataatggctaggataatagatgaggtgaaagaatgaataaacaagtgtttagtatggatttttatggtaaaaatctaagtgtggaagtaggagaattagctaagcaggctaatggagctgtattggtaagatataatgatacagttattttatcaactgttgtggcagggaaagaaccaaaaaatgttgacttttttccattgacagtaacttatgaagaaaaattatattcagttggaaagattccaggtggatttttaaaaagagaagggcgacctagtgaacatgggacattaacagctcgaatgattgaccgtccaattagaccattatttgcagatgggtttagaaatgaagtgcaaagtgttaacaccgttttatctgtagatcaagatgcaactccagaaatggcggctatgttaggtgcatcactggctttatgtgtttctgatataccttttaatggccctattgcaggggtcaacgttggtttggttgatggtgaattcattgttaacggaacaccagaacagctagagaattctttaataaatttagaggtagctggaaccaaagatgctatcaatatggttgaagctgatgctaaagaagttagtgaagaggtaatgttggaagcattattgtttggtcatgaaaaaatcaaagaattaattgctttccaagaaaaagtagttgaggcttgtggaaaagaaaaaattgaaattccattatttgaattaaataatgatttagttgaagaagttgcagtacgtgctaaagccgaaatggctgcagcagtttcaattcccggtaaattagagagatatggagcaattgatgatctaatcgctcaagtgacagaggaatatgacaatagagaatatgaaaatgaagaaataaaagctgatgtgatgaaacaagttggaatcattttacatgatctagaaaaagatgaagtacgtcgattaattactgaagataaaataagaccggatggacgcaaaatcgatgaaatcaggccattagattcgcaaattgatttgttacctcgagttcatgggtcagcgttatttacacgtggtgaaacgcaagttttatcggttgcaacattaggtgcaattggagaacatcaaaaaatagatggattagggttagaagatcaaaaacgttttatgcatcattataatttcccgccatattcagttggagaaacaggacgaatgggtgctccaggtcgtcgtgaaattgggcatggcgctttaggcgaaagagctttagcacaagtgattcctagtgaagaagcttttccttatacaattagagtggtttctgaagtattggaatctaatggttcctcttcacaggcttctatctgtgcttcgacaatggccttaatggcagccggtgttccaattaaggcaccagtagctggagtagctatgggactagtaaaaaaaggggatgcatatactatcttgacagatatccaaggaatggaagatcatttaggagatatggattttaaagttgcaggaactgatgcgggtatttgtgcattacaaatggatattaagattgatggtattacgaaagaaattttacaagaggctttagctcaagctaaagtagctcgtaaacaaattatggcaaatatgatggatgcgattgcagcaccacgtgatgaattatcaccatatgcaccaaaagtacaaatgatgaagattgaaccggatcaaatcaaagcggttattggtcaggggggtaaaacaatcaatgaaatcattgaacaatctgatggtgttaagatcgacattgaacaagatggtacagttgttatttatcattatgatcaagctgcaatcaataaagcagttgagctaattgaaaaaattgttaaaaaagcgcaagttggcgaagtttatgatggtaaagtagtaagagtagaagataattatgcttttattaatttgtttgacggaacagatggttttttgcatatctctgattatgcatatgaaagaactaaaaaaatgggtgaagtgataaaattaggtgatatcattaaagttaaagtcactaaagttgatgataagggaaaagtaaatgtttcacgcaaggctttacttcctaaaccaatcaaaaaagaggaacctaaagaggaacctaaagaggaaccaaaggcagaataatgaaaaggcttgttcttgctagtagttcacctagaagaaaagaattattagaattacataagtttgattttataatcgactttcaagaaattgaggaagtgctagatgaaagtttggcacttcctttacgtttagagaagttagcttatcaaaaagcagcacccattgctttaaaataccctagtgatattgttattggagcagatactatggtatgtttagaaaatcagatgctgggaaaagctgctgatcgtcaggcagcttatgaaatgttaaaattgttatctgatcagacccaaactgtttactcagcggtagcaatcattgataatggaaaagtttctacttaccatgatggaactaaagtcacttttaaaaaattatctgatgaagaaattaacgcttatcttgatttaaacgaatggccaggtaaagcaggagcttatgcaattcaaggtgaaggtaaggcattagtcgctaaagtagaaggaaacttagagactgttattggaatgccagtttggatcattgaagaatatttaaataatcatagataaaaaatattgagtgactagaataaaaaagtatgatttctattatctggaaatcatacttttttgtgatgttatgtaatcggttagatttattttattttggtaagctgttaggatattgtcgggatctacaatattgggaattttctctgttaaaatatgtccaatcagctgactgtcattattaaatgtttcaggtcccaataaaaaataagtttcaccatcactaaaataaagtgtgatatctacttcatacatatcagtgcttgggcctccagtacctaaactataaagagggataaaacgctgtctagtttgaacgacaagtttttcaatatcttggtagaaataaaacttttgatatttataatgctgattaatcaaggcagaaagtacatatttaaaatggtgaaaagaatttttacgcttgaaaattcttattccttcttctaaaaattcaatagattggtttcttgatttatcgtaaagatgcatcataaattggaagttagcaaaaataaaaattaaaatatttattaaaaagacgactgcgacaaaatataaattttctaaataataccatttttcgctccaaatccaaatataaataccgtaagtaaaaatcgaagcaataattcctgcagaaatgacctgtcgtattgccatggctctagttagtgggcgattataagctattgttttacttgtttttcgatatccaagcccttttttctctggaactaatttaatattttctaatgcaggaattagtggaatatgcatatctttgaatgttgatattgtattttgaagatcttctaattcagaaattgtttgatcaatgttgcgcttatgaatctttaaacagtcatctaaactgcatttattatttaagattgctttgatatcatcaattgaaatatctaaattacgtaaaaatttcacaagttttaacgtttgtaaatcgtcatggctgtagttacggtaaccattatttgttcttttgggtcggatgattcccactttttcataataaagtatggcatgtttagttaaacctgtgattttttcaacttcatttgttctcatggagacccctcctataaagatattataacgtaaagtagatatttttgtttttataataataatttaattatttattgaatctttaaaagtaatgtagtcatctttataataaatagatgttgtttatttaaggcagaagttaatattttttataatattttgttgaattttataaatattgcgtattttatgtaaacggtaacatttttattgagttttattataaaaaatcatataataaagtttatggagggatgtttatggcagacgtaaaaagaatcgcattattatctggaggcggagattgccccgggttaaatgctgttattagagcagtaaccaaagcggctattaatgaatacgggtatgaagttattggctatgtttatggttatcgtggtctttataacaatgattacatagaattgacagttgataaggtagagaatatttataaagaaggtggaactattttatatagttctaataaagataacttattcgactatcttgttgatgatggtcatggcggaaaggtaaaaaaagacgtttctgatgttggtgtcgaaaacttaaaaaaagctggtgtcgatgtgctggttgttttaggtggtgatggtactttaacaagtgctcgtgatttttcaagaaaaggcgttaatgtaattggtatccctaaaacaatggataatgatttgccagcgactgatttaacttatggatttatcagtgcttcttcagtaggaactgaatttattgaccggttaaatacaacggcaaaatcacatcatcgagttatctgttgtgagctgatgggacgagatgctggatggattgcgttatattcaggaatggcaggaaatgcctcatgtatcttaattcctgagattccatttacaattgataacattgttaagcacgttgcaaaacgcgacgctgaaggttatccatacactgtaattgcagtagcagaaggtgctaaatatgctgatgggactaaggtgattggaaaaatcgttgaagatagtcctgatccagttcgttattcaggattagctgcaaaggtagctgatgatcttgaacaggcaattgctaaccatgaagttcgttcagttaatccaggacatatcatccgtggaggagatatccaagcatatgatcgtattttatcaattcgttttggtgtaaaagcacttgagctgattaaagaaggtaaatttggtaatgttgttactttaaaaggtgaagaaatgtcttatacatctttagaggaagtaatcggtgatgctaaatttggaaaacaaaaacatgtagatcctaatggtgaattagtaaaagctgcaaaagcgattggaatttgctttggtgatgaataagactgtaaaacagtcttattttttataaaaatgtaaataatattatatgaataaaaactattaagattattttattacataaaaagaatcaaagatagtcgaaatgaataattattattgcggtagatattagtctagtataagaagtaccatttgataatatttttttaaaaattttgaattaaatattaaaaatagtacataatattattgaggtgaatttatgaaaaaaccaaaacatgggcaacagtcaagtaatgacaatgctaaagatcaattaggtgatgatgaaatagttgtatcaggaaatcaagaagattctacaattaaatatagataagggaaactaactttagtttcctatttttttacataattgaacgattttatccttaactatagtttgctatatttttttcaggaggttaagatatgttaaaaaatgcatttctaagtattaaaaagaatattggcaagacagttttattatttgtaataatgacagtaattgcgaacttgattattgcaggtttgtcaatccagagtgcttcgaaaaaatcaatggagcaaattagaacatcacttggcaatgatgtaacattgacaacaaatatgcaaaatatgatgggtcaacgtgaaaaagggcaagcagttagtgaagtagcagcaagtgttacaattgcgatggctgaccagttaaaagatttaaaatatgtaaaaaattataattatgctatttcaaccacagcaagtagcgatgatattacagctgttgaattgaccacaagtcaagataatcaaacaatggaacgtcctgatggacaagaaaatttccaatcagcaaatcaaggagatttttcaatcagtgcaaatacgacgatggaatatttagatagtttcacagaagaaagtagtactctaaaacagggacgattattatcaagtgatgatgccggaacaaataattgtgtcattgaaacaaatttagctactgataatgatttaaatgtaggtgatacatttacagtttatactactataaatgaagaaacagtaacacaacaattaactattgtcggaatctacgaggtgacagatgctaaaacaatgggtggaccagggcaaagtaatccgtttaatacaatttatacagatttatctattggtcaaacattatcggggagtgaaacaaatattacatcggcaacttattatttagatgaccctgagaatattgaagcttttcaaaccttagcacaaaaaaagagtgatatcgattttgagacatatacgcttgatgcaaatgatcgtttatatcagcaaaatgtaagtagtttagaaaatactcaatcatttgcaacaatgtttttaatcgttgtaattggtgccggaagtgctattctatgcttgattttaattttaacaatcagaagcagatattatgaaattggtgtatttttatcattaggacaaagtaaagtgaaaattattttacaacaattatttgagatgcttttgattgcgactgttgcctttgttatttcactaggtaccggaaagttagtatcaaatgtagttggaaatatgctagaatctggaacgaacaataatcaagttcaaatgcagatgccggaaatcagagatcaaaataacgatagcaataacactgattcgacatccggtaatgataaaatgttcgatcaagcatttaatggaccggaaaatacagaattagatgtgtctttaacaactactacagtaatgcaattagcggggattacaattgcaatttgtcttgtttcaatcgctattccatctgcttatgtattacgattatcaccacgtgagattcttgtgaagaaggaggggtagagatggaaacaattttgaattttgaagatgtttcataccattatttagatggttctagtaatgtaagtattttgaataaagctaattatagttttgaaaaaggaaaaatctatgcaattgttggcgctagcggtagcgggaagacaacaactattgtattggctggtggtttagataagccaaaaggtggaaaagttatttttaaaggccaagatactgcaaggattggattaaataaatatcgtcggaatgacatttcgattgtgtttcaatcatataatttgattcattatatgaatgcttatgaaaatgttgctaatgcaattgaaatagctggacggaaggtccaaaataaaaaagaatattgcctggatattttaaaaaaattagggctttcaaaagaacaaagtttacgagatattcgcaaactttctggaggacagcaacaaagaattgctattgctcgtgcaattgccaaagatgttgatttaattttagctgatgaacctacgggtaatcttgatgaaaagaattctaaagaaattttaaaaacatttatcgatttagctcatcaagctaataaatgtattataattgttactcattcgccatcattggctcaaaagtgtgatgttcaattaaaaatagaggacggacaaattgttgaaatttaaaaggctgctcaaacagccttttaatcattgatgggacttttataaggatgacggtgatcaaataatttatcacgattaattttttcattaatataatgatcataattcaatctaaagatacatgaaaaaatcaaatcaagcaaataagaaatcgatgttttggatgaataaggagctatcttagaaaatatcttttctcgtgatcctgtattcataatataagtgcaatattttgataattgattatccccgatagaagtaatacccaaaaggggaacatgcatcttttttaaaaatttcgcaagttctaccatttcattcgtttcgccggaatatgatataagaatggctacatcatcaggactacaagtatatgataagaaaccttgctcaccagcatgagctcgcatttccaccattttaccaattcgcatcattttgtgttgaaaatcaaaaccagctaataaagaattaccatttccaaaaagatagatgcgtcttgcttgatcgagtaaattaataattttgtcaaggttcttaaaatcaactaagtttaaggtgtcttcaatagcttcttgatgcagattggcaatccgatatgcaatttggctatttgagtcggtgtttccaaaaggaaagttgacgtcaacacgttttttgttttttttatcaaactgtaattcagctgaatatttgattttaaagtcaccatagccattaagtcctaatttacggcaaagacgaacaattgttgctggagaagtataagtttgtttagctaattcttttactgataaattaagaatatcttcaccattatctaatatgtatttcgcaattgttttttcagaactggagaaatctaattcaaattctaattgagtcataatactcataaaatcacctctatttagtatatcatgaaacattgtttcataaaactggtatttattaaataaaatatgaaacttgattataaggtcagaaaaactcatttacttatctttacagattaactaaaatggtatgtgaaagagaggtattgtaatggaaaagaaattaccagataatttttattggggtggctcagtatcaagttttcaaactgaaggagctcgtaacgaaggtggaaaaggcgtttgtatttatgacgttagaccaactgatccagaattttctgactggtcagtaggaattgatgaatatcatcgttatgatgaagatattgctttaatgaaagatatgggattcaatttttaccgtttttcaatttgctggtcaagaattattcctgatgggactttagatgaaccggtaaatgaagaaggaattaaattttacagtgatctaattgataaattgattgctgctggtatagaacctatgataactttagtgcattttgatatgccttataaattagtaaaagaacataatggttttgcatcacgctatgttgttgactgttttgaaagatatgctcgtgtatgtatcgaacgatttggtaatcgagttaaacactggatgtcttttaatgaacaaaatttacatgggatgatgttgcgtgtatctaacgctgaagaaattcctgaaggtgtggacccagctaaacatttatatcaagtcaatcacaatgtttttattgctcattgtaaagctgtcaaagcattaagagaattacagccagatgctcaattctgcggtatgaatgcagttactaatatttatccatattcaaatacgccaaagaacaatttatttgcatggaaagcttatcaatatatgaatggtttccactgtgatgtttttgctaaaggaaaatatccagattatatgatagcatatttagaaaaccgtggatggatgccaacatttgaagaaggcgatgatgaattattaaagtatactgtagattatattgcttttagttattatcgctctaatactgttactgaaggtgaatttgattatacaagaccatatcatgaagtagttggagaacatacagttaaaaatccacattgcgaagctaatgaatggggttgggaaattgatcctgttggttttagatggactttaaatgatttagcaacacgttctgatttaccggttttcgttcttgaaaacggaattggatggcgtgaagatatgacgcaagaagaagttgatacaatgttagcagctaataaaacaatcgaagatgattatcgtattaattatcatcgtgatcacataaaagaaatgaaaaatgcaatgtttgaagaaggcgttaaatgtctaggttacattacttggggaccaattgatattctagcaagtatgtgtaatatggataaacgatatggttttgtttatgtaaaccgtactaataaggatattcgtgatttaaaacgtattcctaaaaaatcatatcattgggttaaaaaagcatttgaatcaaatggagaagatttagactaagaaggagaaatccttctttttttgctgataaagttaaaatatcctaacttttttcttggcaactattgacttttaagttaggcaggtataacataacagtagttagataggactaacaagaaaaagcgaggaagtgatgatgatgcctttaactatggcgacaattggtgaagtacagaccataaaaaaagtcggaggaaaacaagaagtaaaattatttcttgaatcgctaggctttacaacaggagcgacagttactattgtaagtaagaaccaaggaaatctaattactaaaattaaagaatcaagagtagcgattagtcaagagatggctaataaaattatgatttaactattaaaagggggataattaattgaaaacgctaagagatgtaaaatgcggaactagtgcgagagtcatgaaactgcatggagatggagctgtaaaaagaagaatcatggatatgggaattactaaggggacagaagtactagttcgtaaagttgcaccattaggtgatccaattgaggttaaagtacgaggatatgaactatctttgcgtaaagccgatgcagcaatgattgaagtattatagtagtaaaatatataggagggtgaaaaaatgtcaattacaattgcattagcggggaatcctaatagtgggaaaacaacgctatttaatgctttgactggttccaatcaatttgttggaaactggccaggggtaacagtagagaaaaaagagggtaaattaaaaggtcataaagatgttaaattaatggatctacctggtatttattctttgtcgccatatactttggaagaggtagtggcacgtaactatctaattcaagaaagaccagatgcaattatcaatattgttgatggaacaaacttagaaagaaatctttatttaactacacaaattatggagttggggattcctgttattatggcaatcaatatgatggatatcgttgctaaaaataatgataagattgatgtaaaaaaattatcaaaagaattggggtgccaagttgttgaaatttctgctcttaaaggaaaaggaataaaagaagcggctgatcgtgctgttactttagctaattctaaaagaataaatgcaccaattcataaatttgatagtgctgttgaagaaaaattagaccagattgaagcaatgttgccaagtgatattgcagtggaacaacgacgtttttatgcgattaaattatttgaacgtgatgataaaatttcaggattaatgagtagtgtacctaatgttgaaacaattattgatcaaagtgaaaaagaattagatgacgatgcagaaagtattattactaatgaacgttatcaatttataacttctattatagatgattgttataaaaaacatagtcatgatcaattatcagtttctgataaaattgaccgcattgttacaaaccgctggttagccttaccaatctttgcagtagtaatgtttgtggtttattatatttcagtaactactgttggtacttgggcgactgattgggcaaatgaaggtgtgtttggtgatggatggagtttatttggactagcagttccatcaattccaagcttaattgaaggattattagaatcattaggaactgcggcctggttaaatggcttaattttagatggtatcgtagctggggtaggtgcggtattaggtttcgttccacaaatgttagtgttattctttttcttagcggtgcttgaatcatgtggatacatggctcgggttgcatttattatggatagaatttttagaaaatttggattatcaggtaaatcattcattccaatgttgattggaactggatgtggggtaccaggaattatggcatcacgtactattgaaaatgatcgtgatcgaaaaatgacgattattacaactacgtttattccttgtggtgctaagttaccaattattgcgttaattgcaggtgcattatttggtggtgcatcttgggtagcaccgagtgcatattttattggaatagctgcaattattacttctggaattattttaaagaaaacaagacgttttgctggtgaaccagcaccattcgtaatggagttaccagcgtatcatatgccgacgattactaacgttttaagaagtatgtgggaaagaggatggtctttcattaaaaaagctggaacgattatcttattatcaagtattttagtttggtttacttcatactttggatttgtcgatggacaatttacaatgttagaagatactcagttagatcatagtattttagcatcaattggtaatgcaattgcatggatatttacaccacttggttggggtgattggaaagctgcagtagctgcgattacaggtttagttgctaaagaaaacgttgttggtacattcggtattttatatggatttgcagaggttgctgacgatggagcagaaatctggggaaccttagcagcaagctatacacaaattgcagcattttcattcttaatctttaacttattatgtgcaccatgttttgctgctatgggagcaattaaaagagaaatgaataatggccgctggacagcgtttgcaattgtgtatcaaactgtatttgcttatttagtagcatttagtgtttaccaaattggaaatttagttattactggaacatttacatttgctacagtaattgctatattagtagtgattggttttgtttatctattagttcgaccatataaagaagacaatcgtttaaatatcgatttaaataaaactgtaactgaaaaatagaaagggtgataacagtgaactggctaattgaaaatttatcgactatcatcgttagtgtcattttattatttgcagtcctattagcaatcaattcaatcagaaaagataaagctaatggtaaatctagttgtggcggaaattgtggtagttgtggtactagttgtcatagccgcactaatagtttagtagatagttatcatcatgatcacgggaagtgttagtacttccctttttctttttttgtaaaaagaatacaaatattctttaaaataggtatacttatataataaataatcttaaggaggaatgttatggagaaaaaagcaatttttttagatgttgatggaacattggttgctaatcatggcaaaatgactgagcaggtaaaaaaagcaatcactctagcccgtaatcagggacataaagtatttatttgtacaggaagaaataagataggaattagaaatgagttagaggaagtaaattttgatggttttattgctagtgctggaagctatatcgaagttgctgatgaagtagtccatagccgttattatgatcgtaaattaattgaaaaagcttgcgatgtatttaatcgtaataatatcgtatataattatgagtgtaccgatattacatatatgtcacccaaaatgatggaattttttgtaggtggaaataatgaggaagcgactaattcggagatggaacgcttaaaagctgaacaaagtgataaatttaatgtaagagatatgaatgaatacgatggtcgtggaattcataaaatatcctttattgcaatgaagcaggaagatttcgatcatgcttttaaagaattgaaagagaactttaactttgtagtacatgatatgtttggcagtaaaaatattaatggtgaaataatgtcaaaacttgataataaaggaacaggaatcaaacgaattgttgattatctaaatatagatatggaagacacaattggatttggtgatagtatgaatgattatgaaatgatcgatgcagtcaaatgtggagtggtcatggacaatggcagtgctcggcttaaggaaatagctgatcgaatttgtaaaagtgttgatgaagacggagtctattatgaatttattgatttaggaataatttaagttaaaaagattataaaatataaattgaaatattattctgatattggttgacttcttattgttgctgtgatattatatatgagtaacgagcaatgaatatttaacttacagatgtgaaagttgtatttataagcaacttagcatctgctttttttatagtaatgctttttataataaaaataggaggtacgtctgatgaatacaggtacagtaaaatggtttaatagtgaaaaaggttttggatttattacaaaagatacaggtggagatttatttgttcacttttctgcaatccaaggtagtggattcaaatctttagaagagggtgctaaagtaagcttcgatatcgttgaatctgatcgtggtgaacaagcagcaaacgttgcagctttataattaaccaaaagtctcaatagagactttttatttttgactaatttagcactttcctattgacactgctaaatagttgtattagaatatctttagcacaaatgaatgaggagtgctaatatttagaatggagatgtgagtatggctgagaaaaaacaatttaaagcagaatcaaaaagattattagatttaatgattaattctatttatacacataaagaaattttcttacgtgaattgatttctaatgcaagtgatgcaagtgataaattatattataaagcacttacagaaaatatttcttcaattaatcgcaatgatttaaaaattatgattgaaatcgataaagaaaatcgtgttttaactattaaagataatggaattgggatggataaagatgaattagaaacacatcttggaactattgctaatagtggttcatttgagtttaaaaatgaaaatgaacatgatgatattgatattatcggacaatttggtgttggtttctatgcagctttcatggtggcaaaaaaagtagaagtgatttctaaaaaatatggaactgagcaaggatatacttgggtatctgaagttagtgatggctatgagatttttgaaactaatgttgctgatcatggaactacaattaaattatacttaaaagataatacggatgatgataactatgatgaatatttaaatcaatatcatattcgtgatttagttaaaaaatattctgattacgtgcattatccaattaatatggatatgacagtttcaaagaaaaaagatgatagtgatgaatacgaagatgttattgaaaatcaaacattaaattcaatggtaccattatggaaacgtaataaaaaagatattactgatgaagaatataatgatttctacaaagataaatttaatgattttaatgatccgttgaaagtgattcatagccgagtagaaggtaacgtttcatatgattcattattatttattccttcaaaaccaccaatgaattattattcaaatgaatatgaaaaagggttacaattatattcacgtggtgtcttcatcatggataaagctagtgaattagttcctgaacatttccgctttgttaaaggattggttgattcagaagacttatcattaaatatttcaagagaaatgttacaacacgaccgtcaattaaaagtaattgctgataaaattgaaaagaaaattcaatcagaattagaaacaatgttgaaaaaagatcgtgtaaaatatgaagaattctttaatagttttggtttacaattaaagtttggtatttataatagctatggaatgttaaaagaaaaattacaagatctgctattatattattctagtaaagaagaaaaacttattaccttagcggaatatattgaacatatgcctgaaggtcaaaaggagatttattttgcaagtggtgaaactcgtgaaaagattgccactttaccacaagtagaagtagtcaaagacaaaggatatgatgttctatatttaacagataatgtagatgaattctgtttccaaatgatgcgtgattataaggaaaaaccatttaagagtgtagctcaaggtgatttagatatcgatagtgaagaggaaaagaaagaattagaaaaaactaatgaagagaataaagacttattgacagcaatcaaagattctcttggtgataaagtcgttgacgtaaaagtatcttcacgattaaaatcacatcctgtttgtctagtttctagtgatggagtatcatttgaaatggaaaaagtcttaaatcagatgcctgaaggtcaagaagtaaaagcaggtagaattttagaaattaatcctaatcatgatattttcaatgctatgaaaaaggtttatgaaaataatcctgataaagtaaatgattatgcaagtatcttatatgatcaagctttattgattgaaggattctcaatcgacaatccagttgatttttcaaataaaatttgtgatttgatgattgaattgaataaataattgaagaattttaaagggtagatgttaagtctacctttttttgtactatttagtaaaaaaattactaaatacattaaaaaattgagcgattatgtgtataatagacatatatgaaaatagagtgagagggtatatatgttaaatatttgtgggattattgctttttttatgatgtacatttatgatttgaatttaatttatttaggtaataaaatttttaaaaagttttttgcgattgggtcaataatattagtatttgctactttagcgaatattattatttattttcctaaaaaaatagatgcacactttattatctttttgggacttgcattactggcagcgatagggttaatctatacgttattttttgcgttaaaatttgatgatgcatataaaaatactgagaataaacagccgtgtgtaaaaaccggtgtctatgccttatgtcgtcatccgggggtgcacatgatgattttaatgtatttatgtttatatctagcttttcaaaatgaaactatgttatttatgttgattggatttaatctattaaatattgggtatgtgattttacaagacataattattttccccaagcaatttgttgattacgatgaatataaaaaaatagtaccatttcttgttccaacaattaaaagtattagaagctgtattagaacatttggggaggtgtcaaaatgaaatttgaggataaattaaaagcacggagtcgagaagatgtttggaatgaatactgtggctttttagatttatcgatggatgaatttgttcagattcaaaatcgtctgatggaagaacaaattgccttatggtcacgaagcccattagggaaaaaaatattaaaaggaagtacaccaaaaaatattaaggagtttcgtggactagttccattaacttcttatgatgattatgctagcgacttattacaaaagaaaagcgaacttttaccagatgaaccggttttatggatccagacaacttgggagggtggtaaacatcccatcaaggtggctccttatactgaaagtatgctggatacatttaaacgaaatgtctgtgcctgtttgttattgggaacttcaacaaagcgaggggattttaaagcccgttcgacagatacgattttatatggtctagcaccattaccttatgcaacaggcttgttaccattagcatttgaagaggaaatcggtattgaatttttaccgcctgttaaggatgctgtgaaaatgagtttttcaactcgaaataaagtaggatttaaattaggattgtcaaagggaattgactatttttttggtttaggaagtgtaacttattatgttagtttaagtttaggaaaaatgagttctggtggtggcggtgctatttctttattaaaaaaatctccattacgttttgctaagattgtattagcaaaatgcaaatgcataaaagaaggacgtgagttaaaacctaaagatatttttaaattaaagggatttatggtagcaggaacagataatgcttgttataaggatgatttagaagaattgtggggtattcgtccaatggaaatatttgctggaacggaaccaacttgtataggcactgagacgtggagccgaaatggattatactttttccctgatgcttgtttttatgagtttatcccaagtgacgaaatggagaaaaatttagctgattctagttatcagcctcgaacagtattgataaatgaggttgaagaaggaatgagttatgaattagtaatatctgttttaaaaggcggagcctttatgcgttatcgagtaggtgatatgtatcagtgtattgatcttaaaaataaagatgagaatattaaattaccgcgatttaaatatctcgatcgggttccaaatgtcattgatattggcgggtttacaaggattactgaaaattcgattgatcaagttgtcaaattatcgggacttaaaatcactaattatattgctaaaaaagaatttaatcataataatcgtccatatctgcatctatatgttgaaatggatccacatgctcaaatcacccaagctatttcaattgaaatactaagggaacaattaagcatttattttaaatatgtagatcaagattatcaggatttaaagaaaattctaggtatcgatccgttaaaaataacaattataaaagctggaacatttgcctattatgaaaaaaatcattctcataaaattaaaaaaattaatcctccaactttagaaattaatgaactgttaacgattcaagatcaggattatcgggttgaaatgggaggacgactatatgaataattatacatatgtctcgattattgcgctgtactgttatatatttttatttatttcattatcggcttcaaagaaaactaagttgattaaagcttttatgacattgttaatggcgatgatgttttggactggtggttctttctttatgcgttcaatgtttggaccatcagtcaaattttggtatgatatttctttattgggtttatgtctagtaccatatgcgtttattagttttgtccatgaatttttatttaattcacctcataaaaaagatactatttggttctttctttttgtcggacttttcattattaatgctacaacagaactcttgctgccagcacctgaatatacaataagggctagcgggattccagcattttattatacttctaatgtttatacgtatattttttattgtttctttctagcaagtattatttattgtgtttcgttgatcataaaaggctttaaagaaaatcgtaatcaggtgatccggctaatgccaatgtttgctgggattgcatgtttaatatttggaaatacttgtgttatgttggggtggtttgctggttttccaattgatattgttgctggggttattaatgcaatatgtatgttctatactttgtataaacgacgtttatttaggcttaatcttttagtttcacgacgtagcagttatgtaatagctggaatgttgtcaattattttatttgctaatttagttggtacatttcaaaatattttatttgaacattttggtttgattactaaaaattattatgtattagtaattgcagtagcttttacgattgtaactgcgataatttatacaatgttaaaaaaatttattgatgcaatttttataaaagaagaaattcagcaatcagatagtttaaaagagttttctaactatgtttcaaaaactttgcaagtaaatgaaattgtcggggcaatgggtgaaataattttgaaatgtgtcgaaaccaaacaagtgtatatttgtcttttagatgacaatggtgattattcaattgagtacagcagttcaccgttaagaaaaaataactatattattaatcatgaaaatcctgtggtgattaaattaatgaataacgatgatatgatattttatagtgaatttagacattcaataaattatcgttcaatgtgggacagtgagaaacaattatttgaaaatctaaatattgaaggaattatcccagttaaacaagagcaattaattgggatgatcctgctggctcccaaaccacggcgctcggggtatagttatggagaaattagtttcttgtcttcagttgcttcaattagtgccattgctttaattaattcaaaaatgtatgagacagtttataatgaagcacgtagtgatgaattaactggactgttgaatcgtaaatatttttatgaggctttgaataatgaatatgaaaaattgggagaacgccaattatcattgattttagtaagtgtagatgatgttcggctttataatcaattgtatggtaataaagaaggagatattgtcttaattaatgtagcacgaattatggatgattatgtaaatacacaaggttatacagcacgtttagggggaaaggaatttgggattattttaccaaattatggacctttagaagcaaaagatctggccgaaaacattcgcgagcaaataatgaatatgaataaacgagatagtgactatactttaaaagtagttactgcaagctttggtattagttctattccggtatctgccaatacaattaaacaattattagattatgcagatcaagcgctatatcagtcaaagcgacatggtaaaaatcgtgtatcagtttataatgcaggagtggttgaaagtacaagtggtgtgacgattgttgatgcacatcgagaaaaacagaatatttacttagagtatgcgccgacaatttatgcattgacagctgcaattgatgcaaaagaccattatacttttacccattctgaaaatgttgcttattatgctacaaaattagcaatcggatgtggatatgatagtgaattagtcgagattattaatgaagctgcacttcttcatgatattggtaaaattgggatttcagaaaatattttaaagaaaacttctaaattaagtgatgaagaataccaaattatgcaatcgcatgtggaagcttcagttaatattattcgacatttaccttcattggactacgttattccaattgtcttaacacatcacgaacgttatgatgggcgtggatatccaagaagaatttctggtgaagatatcccggccggaggaagaattatggcaatagcggattcttttgatgcaatgacttcaagaaggagttataaagaaccatattcattagagtatgctcttaatgaattaaagcgtaatcggggattgcaatttgatcccgatttagttgataagtttattgaactgataaattctggtataattgaagtaagaggtaatcaaaataatgagtaaggaggaaaaataatgtcattagaccaaattattaagcagcgccgaagtattagaaaatataaaaagaagcctgtttctaacgagcagatacaattgcttattcaagcagcagtcgaagcaccatcttggaaaaatagtcaaacagctcgatatcatgttattacatcacaacctttattgaatgagtttaaagagagatgtttaccggagtttaatcaagaaaattgtaaagatgcaccggttttaatagtaacatctttcattccaaatcgctcaggatttgaacgtgatggaacgcctagtaacgaactggcaaatggctggggctgttatgatcttggacttcacaatcaaaatattcttttaaaagcgacagaattaggattaggatcattggtcatggggattcgcgatattgataaaatcaagggattgttagatatttctaaagaagaaataattgtttcagttattgctataggtattagtgatattgagccagaacggcctaaacgtaaaacggttgaggatattacaagattttattaactattacttttgtaatagtttttttgtgcatttcttttgcataaaattttattttgggctatactatatccgtaccccctaggaggggggaggaggtcttatgaaacgtaaatatagtgtaaaagggatgacttgttcagcttgtgaaaatcatgttcataatagtgtttgtaaattaccgggagttgaacatgttgaggtgaatttattaacaaattcaatgaatgttgaatttgatgaaacaaaagttgatgatagcatgattattaaagccgtaaaagatggtggatatcaggcgagtagttatgatgatgcattagttgataatgacgacttaagtaatttgaaaaggaaattaatttattgtttcatcgcacttggattactgatgtatgtatcaatgtcatcaatgctcagttatccaatccctaatattattagggataatgtttattttaatatcatattacaaataatctttttgattccaattttgattttgaaaaaagattactttgttaatggttttaagaatttgatccattttgatccaactatggattcgttgattgcacttggtgcgggagctgctattgtctatagtatttattcagttgttttagctttaagcggatctttaatggagatgcatttagtccataatgtttattttgaatctgctggtatgattgttacattgattagttttgggaaatatcttgaggctaaatcaaagaagaaaacaactgatgcgattgggaagttattagaattggctcctgatgtcgcttgtcgttttaatgatggcaaagaagaaattgttaaaatttccgaattaaaaattgatgacctggttctagtaagggcaaatgaaacagtgccagtcgatggtaagatagtacaaggatttagttctattgatgaatcaatgattactggtgaaagtcttccgattgaaaaagaagtaagtagtttagtgattgggggaacaaataatctccaaggtacttttatatatactgtaacaagaacggttgaggatagtacattagccaaaattattgaattggttgaagaagcatctagttccaaagcaccaatgactagaactattgataaggttgttaaatattttgttcctacagtaatcgtaatagccctaatcacttttgtaggatggttgataatgggagaagatttgaattttgctattactagcgcaattgcggtattagttatttcttgtccatgtgctcttggtttggcaactccagtagcaatcatggtgtcaacaggagttggagcaactaatgggatcctaatcaaaagtgcagaagtattagaaaatgaaaataatattgacgtagttgtttttgataaaacagggactctaactaaaggaatggctcaagttagtgatatttatagtcacaaattagaattagcacaagtaattgcgatcattgcatcgctagaaaagggttctagtcatgttttagcgaatgcttttattcaaaaagctgctgagatgaatttagaattaaaagagattactgattttgaatcattaagtggtttgggaattagaggaacaattgataatgttgaatatgcagttggtaatttaaggatgatgaaagagagtggaattgatttaagtcgatatcaagaaaaaattgatttatatttaattcaaggtaaaacattagtatttttagctcatgatcaagagctgatagggttggtgagtatttttgatgatatcaaagatacaagtcgtcaagcaattcagcgtttaaaagaaatgaaaattaaaacagttatgctaactggtgatctaaaaggtactgcaaatgctattaataaacaattaggtttagatgaggtaattgctgaagtcttgccacaagataaagaaaatgtaatccaacaattgcaagcacagggcaatagtgttttaatggtcggtgatggaatcaatgatgctcctgcgctagttcgtagtgatgtgggtgttgctatcggtaaaggaaatgatattgcgatagatgcagccgatgttatcttgatgaaagatgatattcgtgatatagtggcatcgattgaattatcaaaaagaacaattattaatattaaagaaaatttattttgggcatttatttataatgtgatagggattccaattgcagccggtattttctattatagttttggattaagattagatgccatggttggttctttatgcatgtcattatcatcagtttgtgttgttactaatgcgttacgattaaaacgctttaaaccatactatcaaaaggagaataagaagatgaaaaaggaaattgtaattgaaggaatgatgtgtcaacattgtaaaaaacatgttgaagaagctttaaatggcttagcagacacaactgctgcagttgatttagaaaataatcttgctcgtgttgaaacagttcaagatgatagtattttgaaaaatgctattgaaaaagctggttataaagcggtaggaattaaaaatgtctaatgaaaaagtcttattacgtttaaagacagcgcgaggacaaattgatgcagttattaagatgattgaagatgagcgttactgtattgatatttcgaatcagttattagctattcaatcactaattaaaaatgctaataatgaggtattatctaatcatctcaaccattgtgttaaaaatgcgattaatgagcatgatgcagatcagaaaatagacgaagtaatcaaattattaactaaattataaaaaatcagttattgaactgatttagtagttaaatgatgtaattttttgataagtattgttttcaagaagatctactgttgtttgaacgatgattaatcgcttattcttaacaaaagcaatgcaattataaattgaatcatttgaaagcagataaccattggttatttgctttttatttttaaagttaacactgtttaaataatcgttcaaagcatttttagcttttttttctgaattatagtaataataattaacaatcaaagcatcattatcattttcttcattataacttattgcctctttgatcattaaactgctgcttttattaaaagtattatattcatcattgttactagatagaccaagtgctgataatgtaatgatcctatcattaagcgggagtgtctcacgcccgataaaatcgattgaaaatccagcaataattaaaacaattgaaacaattaataaccaatttgatataataaatggatatttgctaattttattatttgcttttttattacttaaagttagtttgatcttttcagtagtgagatgatgattgaagaaacggattagtaatgctgggcaaaataataagggaatataatgtaaaattattgacccgttcgtgataaattccattgggttttgattagcaaaaacacctggaatcagtaaaaaagaaagcagcatagcgacaaaaataaaaataatattggagatggtcttattgcgtttaaaataagttagcagcagcgcttgatctgtacccttaatattggctgcttgagcggctttaaaaacatatatctttcgtgatttaccaataaattcataaccgtggtttacataatttaataaccactgatcacgctgttcacgattgtttttagaagattttttttgaggtacaaaaatatctgctctataatagagacgttgctcatcttttttaaaaactgtaaacatatcaacgcttttgcaattatagcctgactttgataaattatttagcatatcttcaaattgtttatactcactagtatcataattagttaatcttaatttcataatcgactccttataaatatattattagattatcattttttatccaaacaataaagaaaaaccgtgtaaaacacggtttactttgaaaatgctgattctggttcttcgttaagataggctgattcatctaataaatacgattcagaaatattttgacaatgatcgcccattcgttcgagattagcaagaatatcgacgtaagttgaattaactagtgctgaattttcaattttacgaccaactcgtttgatatgacgctgtttagcttttttgttgaagtaatctaaatctgcttctttgtcgtcaacataaacaatatcatccaaatcatgagtatcaaaggctttaactgcgtgatttaacatatcaatgaccatatccatcatcgcttctagatcttcacgagcttctggtgaaaaatcttctttttcatcatagattgcttcataatatttaacaatgttaatacataaatcaccaattctttcaaaatctttaatagttttcatatttgctaaatagtcattagaatcatggtcatttagagtttcatgcgaaatcaaaactaagtactcagtaattttactgtctagtgtattaatagcattttccatttcataaacaccatctttagctaatgggtttttagtttcaaaataagctctaattccttcaactgcttcaattgtaatatgacccatctcgattatcttgtttttagcaatagctaaagcatgactcgggaataactgaacaacattttgatctaattcgcttaaatccatatttatttcttttttactgctcggtaagatttttttgataagttttacgattgctggtattaaaggaaaaaagaatgccgtagttacaacgttaaagattccatgagctactgataattgtagctcaggtaaaatatttaatgctccagcaagccattctatcaagagcgtgaatggcgataagacgatcataaataatagtgatccaaccacattgaataatacatggaagaaagcagcacgtttagctggtactgttccaccaaatgaagctaatacggcagtaatcgttgtaccgatgttacttccaaaaaggaatggtaaagcgatagataaaccgattgctccagcaccgtacatctgttgagcaattgcaattaccgctgctgaagattgaactgctgttgttaataatgttccacccaataatcctaaccatggattttgtgatagataattcgctacttgtgtaaattctgggacttttgaaatatttgctaaattatctcccattaactctaaaccatagaataaacatccaaatccaaagatgatttgtcccatatattttgtttttttgttttttgaaaacattaaaaaagctgccccaaggataataaagtatactgcatattgagatacttttaaccctacaaatacggacgtaataactgttccgatgttggcacccataattattccaattgattgttcgagggtcatcaaaccagaacgaattaaaccaattgctaatgctgttgttcctgaacttgactgaatcaaacaagttacaaatgcacctattactatacctttgaatggactagaagtatacttatcgatgatatctttcattttatcacctgagtatccttttaaaccatcgcccatgtactcaattccaaataaaaacaatcctaaacctgcaagtatcatcggccaatcaatgtccgctaacgtcataaaatcacactcctatacacaaacataatatagaaatgttaagtaattgtaaattatttgtaaaataaattaacacaatcttaacatttggataaaatacttaaaattattggataaatatgttattatatggtgaaataaagagtacagaaggaggttgaataatgagtgagagatctaaaaaatttttatcgtattaccgtccatatttaaaattatttttagcagatatgttttgtgcaatgattgctgcaggaattacattggtttttccaatgattattcgctacattacaggaacagttttaatagctgataattttgaaatgggcatcatatataaattagggatttttatggtagttttagttattgttgagtatttatgtaactattttgtggcatatcaaggtcatgtgatgggggtttatatggagcgtgatctgcgtaatgaattatttcaacattatcaaaaattatcatttagtttttatgatgaacaaaaaacggggcaattaatgtcacgtttaacaaacgatttgttttcattaactgaactttatcatcatggtcctgaagacattgttatttcatttattaaattttttggtgcatttattattttagcaacaattaatcttaaattaacattaattgtttttgcttttattccagtgatgggtgcatttatttattattacaatcgtaaaatgaaaagagcatttaagcgaaataaacaaagagtaggggatattaatgcacgaattgaagataatttatcgggaattcgtgtggtaaaaagttttgggaatgaaagtcatgaaattattaagtttcatgatgaaaatagtcgttatgtaagcagtaagaaaaatagttatttttatatgggaaaatttcattcaggattaggtgcttttactagtatggtgactgtagcagcggttttctttggggctatttttatttctaatgatggattaaatacagctgatttaattgcattcttgctttatattaataatcttattgatccagttaaaaagtttattaattttactgagcaatttcaagatgggattactgggtttgaaagattcatggaaatattggaaattgaacctgatattaaggataaaaaagatgctcataatttattagatgttaaaggagccattgagtatcggcatgtcgggtttagatacaatcaaaaaagtgattatgtgttaaaagacattgatttaaaagttgctcctggtgagtatattgctttagttggttcttcaggggcaggaaaaacaaccatttgctcattactgccacgtttttatgaagttagtgagggtgatatttttattgacggacaaaatattaaagatattaaattaaattcattacgtcaaaatatcgggattgtccaacaggatgtttatttattcgctggaacaattttagataatattcgttatggtcgctttgacgcaacagatgaagaagtcattgaggctgctaaaaaagcaaatgctcatgattttataatggaattaccagatggctatgatactgattgtggtcagcgtggagtgaaactatctggtgggcaaaaacagcgattaagtatagctcgggtttttttaaagaatcctccaattttaatttttgatgaggcgacaagtgcattggataatgaaagtgaacatattgttcagcaatcattagaatcactggccaaaaatcgaacaacgttagttattgcccatcgtttatcaacgataaaaaatgctaaacgcatttgtgtattatctacaaaaggaattgaagaagaaggaacacatgatgaattattggcaaaaaatggccaatatgcaaccttttataaaatgcagtttaataaatagaagtagaagaactgaaatgaactcagttatttgggtctccaaatgaagaatggtttatttcagaacttctatttttttataacaatttaaagaacagtataaatagttaaaacaagattgtgataatcttttttatatcattattgttgtgttaaaaagctgagaagagtaaactgtatctatacgattaaaggagaaataggatggaattatataaaataattgcccttaataattggaaaagatcaatgtattgtcagttttttttgagatagtagtgaacaatgtttttgtctgaacttagaagtagatactgcgaatttaaaaaagaatttgagagcaaaattattcattcacaatggttttgacctatgcagtaagtaaatatgcaagtgagatagaggcatgcaggtactgattttttgacggtcaaatcgttctatatgatcaaatcgacacagcccttacatatttagagctagagatgggattatttgaagtagtcatagttgcaatacagccaaagatagaagactatatccagttggctacaaaaatggcaaaagaacaaactgaatatttactgattcactaggaaataatgtattttaattttcattacagtctaggataccatattaacatatattacacactaactttggtaagaaggataatgagactctcttattcgactagagaaaatatttctaatatgatggtgaaatacttttaccatttttaattcaaacacaccatctacttgttgatgatctacatatgggtaaatgataaaatatagttatcactttttttaaactaaattaagatgggaaaatatgagaggaatagtatgatacagatattaaaagataaacagtcgatgtatacaattaatacatcgttgcatgagctgcctgtagtaatcagcttaccgcatagtggaacatatataacttctgaaatggctgaaaatttaatggacgatgttatttttcctaatactgattggtatttaccaaaactgtatggctttttaaaagaattagggttcacaattattattaataatatgaaccggcatttgattgatgtgaatcgtgatattaacgataaaaaaggtagttcttataagacaaatctaatttatacaaaaaccactcaaggagctttaatgtataatcacgaattatcagtacaagaaattgaaagacggattgctgattattatttaccttatcatgaggcgattagacaagcattgctagagaagcaaaaatattttaaaaaagtttatttaattgatttgcatagctttggattgaattatggcgcggatattattcttggtaatgataatggtcgtgcttgtacttctaaaactacaaatttctttaaaaaaatgatgaagaagcaaaattttaaagtgactgaaaataatccttttgcaggaggctatattactaaatattatggagccagtgttgaaaattgtgaggcaattcaaattgaattgtggtatcaaacatatatagataaacgttcttttggcaatgaggagctgccggtaatcaataacgagttatttggtgagacaagccggaggatggaaaacgtgtttattgaattaaaaaaatggctaaaggatgaataattttaatgaaagaacaagctatagatagtgcattgattttaagaaaaagctttgagcatggtgaagctttttctgaaatagaaatatctgaattattaaaagaatctaaattagttgaaaaattgacaagagattatgaagacagttccttctttaatatttttagacttatttgtttatcagaaataccatttattgaacaattgccatatactcaaaaaatcattgattttatatctaataatttagctgctgatgaaggtttttcatataatggacaaggtgattgcattgttccttgttacaatgcaatgcttttagaagcatatactcgattgcaaatggcaaagagtaatgaagcacagaatgctctagattggataaaaagatatcaagtatttgagagaaatcaaagaacatcttggcgatatggagaaatttgcaaacatggcggatgtatgaaagctacaccatgttatattgggattggtaaaactgtacgagcattgattacttatgctaaatatattaaaaatgctgattctcatgtcgaacaactgattgaacagggaattgtatatatgttaaagcacaatatgtatcagcgcttatcaaatcagcaatgcattagtaaatatattgataaaatcatgtttcctcaagcatatatgttatcattgacagatttagtatatattgtaaatgaacgaaatttatggtgggatcaacgtacgattccgttgaagaacctccttgaagagaagcaagtaggttcaggccaatggaaaatagaatatatttatagtcataagggatacaaagcttttgaaactaaaagaaattcctcgaaatggataaattatttatataacttaaataagtaggaagaaaaatgtgtcaagaatgttatgtggatgaaagacgctgtacgtcattattaaattcgctagtttgtttagaaaaacatactcagtatatttgtggaacgtgtggaagaaatatctgtatagaatgtgatttaaacgagggttataaaggtggacttttccatttaaaagccttgaaattgctaagatgtatttatgtacagctgattatagttaaaaaaacatgtgtgatatatcgaattgaaaataataatggagaacttcttataagatttttagtagtactggttatttgaaagagtatctaaagaaaaatagtgataaagtatgaaagaaatggcactaatatttaaaatggataaatatattaagtattcgggaactgaagtgcgtaaattaacttttgcggaaatagaaaaatatcttgatgaaaggcaatagaatgttttgaaagtgtaaattacaaacagtttatgtgaagagcatgcttaaatggagaaattagtgagaaaaataattttatatgttgcaatacgccttgatggttatattgttcgtggagatgtggcgttacatgggcaaggtgttaattcagataatcaaaatagcaatcaagaatttttaaagatatagatacagtaattatgggatggaatacttatcatcaaattgtaacagaattgtcacctaagatgtgggtctatgacaatttgattactcatgtttttacacacaaatattatgaaaatggagctaaaattaaatttactaatgatgatgcttacgattttttaaatcttttaaaatcataagtaggaaaaaatatctggatttatggaggcacaaatctgatttcacaattaattgaaaaagattttatagatcgttatcatatgacgattattcctacaattttaagaaaggaaattcgtctttttgaaactactcatgattatgaaataaaactaaagttgattaaatcactaagttataatagaataagtgattgttttatgaacgaagataacattttattataaaagaatttatatttttgttaaaaatggtagtgatgttattgataatatcgctaccatttttaaattaaaactaattaagttatttaattgaattatttaagagataaattatttattattgatctttccttgataacatgaattaccgacaagatcatcttcaatttttaatagacgattatatttacaaatacgttcactacgagacatcgaaccagtcttgatttgtccaatatttaaaccgactgccaaatcactaataaaagtgtcttcactttcaccagaacggtgtgaaataattggagcaatctggttttttacagccatttcaatacaatcaatagtctcacttaaagtaccgatttgatttaatttaattaagatactattgctatagtttcctgcgattccggcttttaaccgattggtattagtaacaaataaatcatcaccaactaattgaattttagctcctagtctactagtaagttttttccaaccagtataatcttcttgatctaaaccgtcttcaatagagataatagggtatttgcttacaagttgttcgtaatatttaattaattcatcacttgtatattgtttaccattaattgtgtaaataccattctggtatagttcactggcagctacatcgagggcaattgaaatatctttgccaggttcataattacattctttaatagctttaatgattaattctagggcatcatcattggattcgagattaggcgcaaatccaccttcatcacccacagaagttgctagattacttcttttcaaaatatcttttaaagtatggaaaacatttgttgccatttccattgcttgatagaaagaattggcactgattggcataatcatgaattcttgaaaatctagtgagttagtagcatggcttccgccatttacaatattgatcatcggggttggtaagacatgagcattgcaaccgcctaaataacggtataatggaatttcaagatagtttgcagcgcaatttgcaaccgccaaagatactgccagcatggcattagcacctaatttttctttattttctgtattgtcaaagcgaatcattgctaaatcaatttctcgttgttctaatacacttttttctttaattagtttggcaatagtctcattcacattgtttattgctttaaatacactttttccacgataccgtgcatcatcgttatcgcgtaattctaaggcttcatattttcctgttgaggcaccacttggaacaatcgcacttccagaaaatccactttccgtagttacttcaacttgaattgttggaaaacctcttgaatctaatacttgtcttgcatatacatttgaaatatatggcataattttatcactccttcattttttattatgaacggctttaatttgctttaatcaaatatattatcttgtttttaataattattatacggtaataaaggagttttttattaatgattcatgtaattgttaattcaaaggtactttacaagattggatacaagtgctaatatgcaattaattttagagatgttaatcaagtgctagataaaggggagaacacgaatgaaaataaatgaagaaagaaatttaccaattggattcattgattctggtttagggggattaagtgttttaaaagaggcgataaagataatgcctcatgaagattttatatactatggtgattctttaaatgctccttatggaaccaaatcagtagatgagattagagatttaacctttgctatcgttgataaattattaaaattagggatcaaaggattagcagtagcgtgtaatactgcaacaagtgcagctgttcgacagcttagaataatgtatcctgatttaacaatagttggaattgaaccagcaattaaaccagcagttgaatcaaaccatggtggtgaaatcttagtaatggcaacacctatgacaataaaacaagaaaagtttaaccggctgctagatatctataaagaccgtgccaaaataataccagtatcatgtaaggggttaatggaatttgtagaacatggaaatttgaatgggagctttttagaagcatattttaatgaaacacttgtcccttatttaaatgatactactgaaacaattgttttaggatgtacgcattacccctttttaagaccgtatttaaaagaatttttaggagagcgaagaatacagattattgatggcagtcatggaacttcatgtgaattaaagcggcagttagcaggaaaaaaattattgcagaaagaaaatcatgaagggaaagtagtaataaaaaattcgatggatgaaccagagatgattgatttgagctggaaattattgaatttgccaatcgattaagttacatacaaattttaaaaatggccgaattggccttttttagtgtgatacaaaaaatgttaaattatggttaaattttcgtataagagtgcaatagagtatacttataaataaaggttagttttaaaatatttagcgagtaaaagaacatgattaaattttgaatgttctttttatactgttggaaaatataatataactgcttataaagtgtaaaaagataattctttgggaggattcctttatgcgtagaaaattatttttaattgttctaactacgtcactattgttatctagtattatttcgatttatgtaattcataatcttcaaggaaatgccagagttatcaattatactggtgttgttcgtggtgcaacgcaacgattgatcaaacaagaattaagtaataagccaaatgacaaattagtgaaaaaaaatagatgatattattgatgaactacaaactggacatggtgaacttggtttgattcgtttagcttctgatgatttccaagaaaatatgactcaaatgaaatttgattgggaggggttaaaaaaagaaatttatttggttcgagaaggcagagataatgggaatttatatttttatagtgaagccttttttgagttggcagataatacggtacattctacggaattgtattctgaaaagagcgtgtattcagcagaaggaacattaataattttgaatctagcgttagcaatactagtgttttttatttataagtataatactaaacaagaaaaaatacgaaaaaaattagagaaagaggaagaaaataataaacaacgtaaagtataacttgcaagactggctgaaaacatgcgcgctcccttaaatgatatttctgaacttttatatattgttgacttagaaacttatgatttattatttattaatgaaaccggaatgaaaatatttgaggttgattcaatctatggaaaaaatgttataaagtcttacaaggaagagatgcgccttgtaattttgtactaactgctatttgaaagaagaggaaaattatacttgagaatttactaatccgctaactaaacggcattacctgttaaaagatcgtttaattgagtgggatggtaaggttgcaagaatggaaattgcttttgatactacagaatctgagatagaaaaacagcagttaaaatttacacttgaggctgaaaaaacgattacagaatgtattggtatattatatcgtgaaaatggcgttagtactgcaattattgaagtgttgagaaagcttgggaattttttatcagcagaaagaacatacataatctatattaaagatgaactaatgtataatgactatgaatggtgtgcggaaaatattatatcacaaaaaaacaccctacaaggaattcctcttgcaatgattgatcggtggattccttattttaaaaatgataaatgtgtaatcattgaaaatttagaagaaataaaagaaatttcattggaagaatatgaaatactagacagtcagtcaataactagcttagtgtagctccgttggaacaaaatggcgaactggcaggttatttaggagttgataatccacctccagataaaattattaatattgcttcattgcttcaaacattatgttatttcgtttcattagcattacaacatgcagagagtcaaaaaaaattatcatatttgagttatcatgataattcaacgaccttttataatcgtaatcgttatattaaagatactcaaaaactttttaatatggatacttcattgggaattatttatttagatgtaaatggtttaaaagatgtaaatgatcaatttggacacgaagttggtgacgcattattggttgaatgtgctagacgtatgaaaatggtatttaaaaaagctgatttttatcgtattggtggggatgaatttattattatttgtcaaagcataaaaaaagagtcatttgaaaaacgagttaaagaattaagtgaaagtttttctaaaaaaccagtttgtcaagtagcgataggaacacaatggactaatgcagtaggtaatattaatgagatgattgctgaggcagatgcaaggatgtatgaaaataaaaaagaattttatcataagcatatgatttccagacggtatcgtcaccatagcgatgagatgctgcatctcactaatattgattatctagaatctgagattgaaaacggtcattttgttgtctatctacaacctaaaattttatgtgaagatcgctcatgtgttggggcagaagcattgatacgttactgtgataatgctgggacattaattccgctttcaataaatttttctatagaatcacttcgtggtaaatcttttgttgaacgtattttagaaacttgtaaaaaatatcaaatacctactaaatatatagaaatagaaataacagaacgagtacatgacgaaaagaattttgaaattaaaacggtaatatcaaaacttcgtagtgctggatttattgtagctattgatgattttggaacggagtatgccaatttagcattattatcggatgctgagtttgatattctaaaattggataagagcttaattagtaatgttgcattaaatccaagaactaagataatcatggaatatatttcaaaaatttgtcatcgattagggctggatatgatagcggaaggaattgaatctgaagagcagttttttacgctgtgttcatatggggttgaaacagttcaaggttatttattcagcaagccgttggcaataaatgtttttgaagaaaagtatctaagttaattttaagaagctaattaaagtttatttaaggtgttgtatgtgaagtgtataaataataacatttatttgactttattttttagttgtcattgacattgtctatataattatctagaatataagtatatagacgtggtattacctttaaatcaattatagcctaagtattagtatgagcaatttttttgcttgctttacttaggttttattcttttaaaagtaatgaatgtttactgattcaatcaagtatgacaaaatagatggacaaggagtgtgaaaaattaagggaaaacaaatattgttagtacttggtaataatccgcaagtatcaaatacttgttgcaatttatttaggcctttgatttattttagactagagaagggtaaaggagcaaaaaaatgaaaaggttagggaaaaggagaatcatttcgctaattatggctttatcaatggctgttacaactgtatttagtgcaaacatttctaatgttagagcgctaaccaatgcagaaaaagcaagggaacttgtcagtaaaatgacattagaagagaaaatcgggcaaaagttaatgttatctttccgtagtggatggacaatgagagatggaactaaaatttcatcggttcaaactattaacgatgaaattcatgagattattggtgaatatgatatagggagtgttatcttatttgctgctaactttaattccgatgcaaaagtaaatgtagaattgacagatggtttacaaaaagcagcaatggacaaagatttaggtaaaaacagtattcctctattaattgctactgatcaagagggaggaatcgtatatcgtttaactggtgggacggccttaccaggaaatatggctttaggtgctagcggtaatactgaaaatgctgttaaagcaggtaatattattggtagtgaattaaatgcggttggtgtaaatgttaattttgcgccagatgctgacgtaaataataaccctaataaccccgttattggattacgttcattcagtagtaatccgcaattagcagctaaatttgtttctgcttatattgaaggagttcaaagcaataatgtggcaactgccgctaaacattttccagggcatggaaatgtagctacagattcgcatacaggtttaccttcggttcctgcgactaaagaagaattatataaaacagagttagtaccttttcaggcggcaattgatgctggaacagatatggttatgactgctcatatccaatttccgaatattgtaacagaagaaatttactcagataaaaaagatgagctgatgagtccgccagctacattatctagggaaattttaactgatttattaagagatgaaatgaagtttgacggtgtcattgtaactgattctatgacaatgcaaggtgtggctaattactttgatacaaacgaaagaaacttattagctgttaaagctggagttgatattctagatattccatttacggatatttcttctatgaaagatatggaatctaaattaattccactgattaatgcatttgtcgatgcttatactaaagaagatggttataatggaattaaattatcattagaagaattggataaatctgtggaaagaattttagtttgtaaatacaacagagatgtcatggatttagcaaatgatacaactacattagatgataaaaaagcaatcgcttcgaaagtggttggttctgttgaaaatcgtgaaacagagagattaatttctgcaaatgcagttactgttgttaaaaatgaaaataatgtattaccacttaaattgactaaagattcaaaagtagtatttgcatcaacttattcaaggaataataatcgttttattttggcttggcaaagagctaaacaggcgggaattattccagagggggcagattataagattttgcagcactataattggacaggattaaacgataaggtaaacagtgctataaattctgacggaactaattttgttgggacaaataaagatgtgctagattggggtactgttcttgtccatgcctcagaaatcagtagtgctagtggaatagatggatatttggtagcttgcccacaattatttactaagtattgtaaagaaaatggaaagcagacggttgttatttcattaaatcatccttatgatgttcaagccttcccagatgctgatggtattttagcagtgtatggaactactagtcttgggctggatattacggaatcattcggtggtggtacagttggagcaacagcagcatttagtcctaacttgacagcaggtactgaagtagctttaggtacatttggagcttctgggaaactaccggtagatatcccaaaatatgttccaaaatctggagtatattcaactgacgaaaatgtctatgaattaggatatggtatagaatatgatgcaattgctaaagatccagataaaaaaggactagcagatgcgattgcacaagctaaagctatagataaaagtgtatatactactgagtcttgggaggcagctgcagaagctttaaatactttaaaagtcgtattgcaaacggctgaaaatgttaatttgactcataaattggcacagtctgttgttgatgaaaatgaaacagatttacgtgataaatataatacggttttatcattattagtatataaatctgacaaaaaagctttatcagatttgattgccgaagcgaagaaattagataaagatcattatactattgaaacttggcaaaattttgaaaaagcattagaaaatgctgaatctatatatgatggaaatgtaccacaagatgaagttgatttagctaaagaagcattagaaaaagcaaaaaatgagttacttgagaaaaataaaaaagaattatcagttgctcttgaaatggctaaacaagtaacaccagaacagttagataaggttgtaccagctgtggtgactgaatttaaggctgcattggaaaatgctcaaataatttttgataaaaaggatgcaaatgaacttgaaataaataaagcttttgaacgcttatctaatgtaatgcaaatgttggaattctataagggcgataaaacacaattaagtgcattagtagaaaaaattgaaaaattaaacaaaaatgattatttaagcgcaacatggaaaaatttagaatccgtcttaacaacggcaaaagatgttttgaacaatcctgatgctttagaaatagaagtaagtgaaacgcatgatcaattagtaagaacctttttacaattaagattaaagccaaataaagatttgttaagtgagttgatcaataaagctgaaaatacagatcaaacaaaatatacagcagtatcattattatcgcttaagagcgcattagtagaagcaaaagcagttcttgataataacgaagcaacccaagatgaagtaactgctgtagaaatattattgaaaacagcattagacaatttggtagtgaaagaaattactctagatgatccaaatgctcaaacaccaccagatgctaaaccaggtaatggtgctataactgcgacaaaaacaggtgatgattctatgatgttaacatttgccttagcgggattattggctttagctggcagtgtgattgtattgaagaaaaaagaagaataatttatacttaagctaaaaagtcactgtatatagtggcttttttgttttggtttgttttgagaaacaggatgatttatttaataagaaatatgttataatattcctaatattattttatagtacattggtttaaacaatatttatttaaaatactaaataaacttcacatttattagttagaaaggggaatttttaatgaagcagcaaaaatggaatattcatacgcatacaacaagatgtgggcatgcaactggactagatattcaatacattcaaagtgcaattgaggctggatttacaatgttaggatttagcgaacatctgccttatcctgaaatacggatttctggggcacgaatgttttatgagcaaaaagatgaatatattgcaacgataagaaaattaaaacaagattatcaagataagattgatattaaagttggctatgaggttgagtatttaaaagatcattttaatgatttgatgaatttgaaaaaagaatgtgattatatgattttgggacaacattttaaatatttaatttatgactatgacagttattgttctgatgaggatgtatatgtttatgcacagtaaatagaggaggcattatctaaaaattttattacatatgtagctcatcctgactattttatgatggggagaaggagtttttcaaatgcttgtgttgatgcggcgcatcgaatagcaaaagctagcatccgttatgatacaccgttagaaattaatctaaatggttttggatatggaaaaaaacaatattatataaacaatgaattaaaggcatgttatccatatccgtttcgtgaattttgggagataattgctatgtatggttgtaaagtaacttttggatatgatgctcattcaccacttacgttattagagcgtgagcgggaatgttgggctctagatattttaagtgatctaccacttaattttattgaccatatcgaattaaaatgagctttatagataaaatattatgcttaaaaattattattaactatattttttgattcaaataagattagtaatttaagaaaaaggagattagaaatgttgtactcaaagaagataaatatggcagatattagagcaagaatatgagtatgtttctaatgttctagaagacaaaaatgattttgaaaataaaattttgccaggttatattaattcttccaacgggattggacttcttgagggatgggttccggaaacagaagtgtttttatggaagatgatcaaattattgactgatttaggattggacattacttgactgaaaagttggctcatggtaccggacatatcggatatgtaataaaaaagaatatagaggaaacgggcatactgtgaaggattaaaggtaactcttcaaatagctaaaaatattattaaagaggataaaatatatctgtcagtccataaaaataatctagcttcattaaaaatccaataaaaaaatggtgcatatattcatcatgaagacgataagaaattttatacacgaataaaaaatcagtttaaagctactctataattaattaaatactagtaaagccggctaaaaacaatgtacaataaataatgggttatttttaaatactaataaataacttgaattaaaaaaataactatattttaatttggaaaggaaggtatgcatgcctgttaattgctagtttagcaaagctaggcaattgagattattagttgcgtactaaagggagtggaattatatatgagaaaatatttcttttttgacattgacggaacattaactaatagtaatcctgggggaattattttaccctcaacttttgaaacattagataagttaagaaaaaatggtcattttgttgcaattgcgacaggaagagcgcactggatggcaatggattttagtcatgaatcaaaaattgataatctagtttgtgatgggggaaatggtttagtcataaatggagaattactaggaattgaaccattagataaaaatatttgtttagaaataattgatgagtgcatagaaaagaaatttcctttcggtgtatctttaggggatgttcctgaactatatacatgtaatgagtggctaagtaattttaaaatgcatacaaaaattattgtagacccacagattgattttcatcgggttgataatatttataagatttttattatggctacacacaagcaggaagctgagttgactgcaatccataaacttggttatatgcgatatcatggtgatcaattaattgttgagccgttggaaaaatatcgtggaattttgaaaatgattgaaatacaaggaggaaaacctgaagatatagttgtttttggtgatggacataatgatatttcaatgatgcgacaagcacctatttcaattgcaatgggaaatgcaattgatgaggtaaaagaagtagctacatatataactaaatctaatcaagaagatgggattgaatatgcttgtaaacattttggatggatagattagctaaatgtggtatactactagtaggtgatgaaaaatggaactaataaaatggattttaatgatagcaggtattttggcttttttaattattggctgtatgatattgctacgtagtgatgaaaaaaagcggagtcgaactaaacagtaccaagaaaatattgatatgctcaacgaaactaatgaaatgttagatactacattaatggaattagaatcttataatgaaccgctaaagaagatatgtgaacatattgataactttaatcataaatttcttggtcaaaaataaccgaaaacagttgacataagattattttttcatataatacaggtatatataaaaactcgttgataaagagagtaatttaattaagtttcttagcgaactggcgttggtgaaaggtcagtaaacaagattaaatgaaccgcactttgaagaggactgtttgaactaatagtagggcagtcagtatgtctactttacagacaagaggggatataagactttttatatcaacaagagtggtaccgcggaaatttcgtctcttagcttttaattagctaagagacttttattttacgcaaggataggaaaggaaaggtaagaaaaatgaagaaattattaaaagtattattagtatgtacgatggcatttacacttgctgcctgcggcggaaacagcggtagtgatggtacgaaagaaattttgattgggatttctccagattatccaccatatgagtctttagagggcaaagatatggttggatttgatattgatatgactaaagagttgtttaaaattatgaatgataacggtggtaattatgaatataaatttaaacaaatgtcatttgatacaatttctacaagtctgatttctgatcaaattgatttaggaatttctggatttacaatgcataaagactgggatgtattatggtcagacaaatacaatgattctagacaagttgctttagttgctaatgatagtacaattactactaaagctgatttagagggtaaaaatattggagctcaattggctgctactggtgaaagtgtagctaatgatattaaagatgctaaagttaaagcagtaaaagatgttaaagttttaattgaaactttaaattctggtgggattgatgcaatcatcttagatgaagcagttgctaaaaactatgtagaacaaggcggatataagatgttagatgaaactttattagaagaagaaaatttaatcatcgctaataaaggaagtgaagatttaattaaagacatcaacaaagcacttgctgaattcattaaatcagataaatatcaagaattaaaaactaagtggggagcataaacgtggatgcattagttgctttttgcacagcagacaatttgatttttttactacaaggggctggtaaatctttattactagccgcttgtgctttgttttttggccttattcttggggttttaggtgctgctgcaaaaatttcaaaacataaaatactaagacttattggaaatgtttacgttgaattgatacgtggaacgcccatgttgttacaaatactttttctctatattgcttttccgttattaatgcgttcgattactggggaaagatttattcctgatccatatgtttgtggtgctattgcgatgagtattaatagtggtgcatattcgacagaattgatccgtagtggaattatgggagttgataaaggtcaatgggaagcttgtgaagtattaggactaaattatacacaaacaatgaaattaatcattttgcctcaggcgtttaaaagaatcattcctccaatcgtcagtgagttcattactttaattaaagattcatcactaatttcggttctaggagcaactgaattattatattcagcacaaattttgggggcgaatacatttaatttgattccgccattattggcctctgctgtattatatttaattatgaccttaacaacatcttattttgcgagaaagatagaaaggcggttatctgtaagtgattaaagttgagcatattactaaaaaatttaacgatttaaaagcagtgaatgatgtctctttagaaataagaaaaggagaaatcgtttgtttgattggacctagtggaagtgggaaaagtacagtgttacgttgtattaatggattagaaattcctgaagaaggaactgttttcataaatgagcagccattgaatgctaaaaaccctcaagcatttaaagaacttcgtagcaaaatgggatttgtttttcagcattttaatctttttccacataaaacagttttagaaaatctaacattagctccaattcaggttttgggaatggaacaagaggcagcgaatcaaaaagcattagagctgttaaaacgagttggattgagtgataaaaaagatgtttatccaaataaattatcgggtgggcaaaaacagcgtgttgctattgctagagcactatgtttaggaccggaagtgatgttgtttgatgagccgactagtgcgttagatcctgaaatggttatcgaagtattggaagtaatgcaggaattagcaaaagaaggaatgacaatggtggtagtaactcatgaaatggggtttgcaagaacagttggagatcgtgtgattttcttagaaaatggaaaaattattgaagaagcaaagtcggaggatttctttacacatccaaaatcagagcgtgcaaaagatttcttaagtaaggtgatgcattaatgaaaattgatttatttgatgttgaagcttggatgactgaatatgaaaccaactatcgatataatttggcggaaacttgtgtagcttcaatgagtattaatgatttattagaattggttgaaaataaaaaaggagtcattgataatttattaaatactaaattggactatggacctattgttggtagtcaaagattgcgggaagggattgcaagattataccaaaatggtgatgccgataacattacgattagtcatggctgtatcaatgctaatgagatggttttaatttctttgctcgaagctggtgatcatttaattacgattacaccgacataccaacaattttattcttttccagaatcattaggtgttgaaactacgcttattccgttgttggaggaaaatgattggttacctcggttaagtgatttcgaaaatgcaattaaggataatacaaaaatgatttgtctcgttaatcctaataatccaacaagtacaaaattttctagagagtttctagaaaatttgactgatttagcaaaagaataccacttatatattctttgtgatgaggtgtatcaaggattaggtgatggtgaagtcgcaatcagtgatttatatgataaagggatatctacagcctctttatctaaagttacatcatttgctggtttacggttaggctgggtaaaagctaattatgaagtaattaaactgataaatgatcgtcgtgattatcatattatttcaacaggttatcttaacgattatcttggaactttagttattgaaaattatcacaagatacttgaacgaagtagaaaaattattaatactaatcgacagattctcattgattggttagctcaagagccattggttgattgcgttgttcctgaagctggaacaatagcctttttaaaatatcatctttcgataaagtctagggaactttgtgctaaattacaacaggatacaggagtgttttttgttccaggggcatgttttgatcaagaatatcatttacgttttggctttgctaataacagtgacgaaataaaaacaggattacaattattttcaaaatggcttaaagaaaatgcttaattttattctttaagcttttttattatcgataaatagatatttataacaagcgaccatattaataaatagtgcaacgacaatgccgattaacatactgacagctatactgaaaacccctagtgactgactaagaaaatatattaaaactatttctaaagtacattgaatgatgctgattgcaaacattaaacgatttttattcaaagcttgaagcagtgcactaagaggggtttctaaataaaagatagtgaatggaatgcacatatattttaaataagtagctccgcttgttgtatcataaaggatttttaaacaaacttctggatataaataaaaaatcaatgtaaacggtagactaattaaaaaactaccaatcatagcaattagaatatgatatctagcagcgctgattttatgataaactacatcattagtgatgatcgggagaatcaggcgataaattacgccattaaaaaaagtgggtgtaactaataatgatatgacataaccgcttataattgcatattgttgatggatcatactttcttttaaaccgaatttggttaaaacatagacgaggatgattggctctagaaagctaactaaacattgatataaacgtgaaccggttaatggcatagcgatatttaacatatctttaatttgcaaattattgacaatactctgcttattaaaggttgtaatatgatggtccttgagacgggttgtcaaatagaggatggatgctaattcaccaacagacattgccagtgttgcaaaactaactagataggtatctgttaagaaagaaaattgtctaatcattaaataactaaaacttaatcgagcaacttcttcgacaaagccagctttagcaactaaaaagacattttgtttcgctaaaaaataatttttaattattccactaatccctacgagcggaataaacaatgccagtgacaacaaaggatagaaagcaccctcattttttaaaaggttatgactaataaatttcgatgaaaaaagtaaggcactcatgacaattatacaagtaaaaagacaaatcgttaaaccggagatgacaatttttttattattatatttagggtttgctacaagtcgaaagactgctgaaggaattcctaattgacctaaggtaatgcataatgaaaccgttggcattactaagatatatagtgccatcgcttcttgtcctaattgtcgcgctaaaatcatgcgattaagaatactaaacaattttgtgattgctgaactagcggaaagaatgataaaagaatttattagttttcttttcataaagcacttcctttctggtgaaatttgtcatataatatgtaagtgacttttgaatggagggctgaaaatggaatcgattaatgattttaaatttaataaacgtgacctaaattttttaataaaactaaaagcccgtgattttaaacagcagaatattcataatatttctgaacaacaaattaaagactacttatttgagcgcaaatggaaacaaagagatgccgttcccatgtgtgaaataattgatgatatcatgaatttagatttttctgaaatttttgattatctgagtttacaagtagttaaagaagcatctcgtttgagtataaatgatttttcggactttatttcaaaatagttgctaaggcaactatttttctttgaaaggagattatatggattggcggattattaatgatttagactacaaccactatatgcaagaatacaagattaatgcacttttagctaaggtttttgcgtataaacaatattcatctcaagaaattgaaacaatgttatcaagtcgtttagtatatcatgatttttctttattttctgaagcagaaatgacattagaaagaattcatgaggcaattggtaataaagaaaaaatctgtatttacggtgattatgattgtgatgggattttagcaacatcaattttagttgaagcttttagacaattaggagtggaagtgggataccatattccgagtcgtttagaagatggatatggattaaatgcaaatcgtgttgaacaaatggcaaataaagggtatacattaattattacggttgataatggaattaaggcatatgaggcaatcgaaaaagctaatgaattgggagtggacgttattgttactgaccaccataattatgatgatgaattaccagatgctttttctattattcatacaaaaatctcacccgattatccttataaagaaatctcgggtggttttgtagcttataaattagcaagtgcattattaaaaaagcatgataaatacttattttcattggcagctattacaacaatttctgatatgatgccattacttgatgaaaatcgagcattggtaaaaagagcattggaatttatgaaagaaaataaatatcctcaattagaattgttattggggagtaatcagacctatagtgttactagtattgggtttatcatcgccccgaagattaattcatttggtcgcttaagtgaaattattaatcctaatcatctcgttaaatattttagaagtgatgcttcaattggaatattaaaagcagttagtgaaaaagcaattgaagtaaatgctaaaagacaagaattaacaaataaacaatatcaaagcgttttaacaatgattgacccgaatgagcaatttttatatgcttatcaaaatgaaatacacgaaggaatcattggtttagtggcaggaaaatatactcgacaatataaccgacctagctttgtgatgacatttgatagtgaaaaaaatctttataaaggcagtgctcgtggaattgaagggataccgttgaataaaatttttgaaaatgttcaagatttgttagaaagttatggtggtcatgctttagcaggtggatttagtgtaggtagtgataaagttgaggagctaaaagaaaaattagaattgtatttaaataaacaattaaaagattatactcctcctttagtggatgtaattgaagttacaggaaatgagattagtaaagttagtgtaaaacaattagagttattagagccactaggcaatggcaatgaagaaatgcgttttttcataaaagatttaccagtaagtaaagttacgtcgttatcgaatggtaaacatattcgttttgatttgtcattaccgcaagtcaaagcacaagcgttattttttaatcatggagatttttttgaacaattaaaagatactaaaatgatcaatgcagttggtaagtttaatattaatgtttttaataatattgaatctgtcaacttaattattgaagatattaaatagtttaaattaaagtataaaaatgttataattaaatatcataggatattatgtggaggaaatagaatggatttaactaagtatgttgcaagtattgaaaactttcctgaagatggtattattttcagagatgtaacaccgttgatggctgataaggaagcttttaaagaaacgattgaccgatttgttgagtggactaaaaatctggatactaatgttgatattgttgctggaccagaagctcgaggttttttatttggatgtcccgttgcatataatttaaatgcagggtttgttccggttagaaaaccgggtaaattacctcgtgaaacagtaagtgaaacttatgctttagaatatggaactaatgaagtgcacatgcatgctgacagtattaaaccagggcaaaatgttattattgtagacgacttattagcaactggtggaacagttgaagcaactgtaaaattagttgaaaaattaggtggaaaggtagtaggaattgcttttctaatcgaacttgaaggattaaaaggacgtgataaacttcaagggtataatatctattcaatattgaaatactaaaaagagattaaatctcttttttaataataagagggggtgacattatggctgaatataaaggtgctggcgatacagttacaattaatgatgttcttgaagtgtgtggtaaatatattacaaatcaagaaagtattgatttaattaatcaggcatacgattttattatggagaagcatgaggggcaaaaacgcaaaagcggtgaaccgtatacgattcacctgatttgggtagcatatattttggcaacgttacaaacgggacccgctactattgcggcaggacttttgcatgatgtcatggaagattgtggagtatctcgggaagaaatggtagaacgttttggtgaggaaatcactacgttagttgaaggggttaccaagattggtaaaatgccatttaaagatgaatctgatgtttatgctgaaaatcatcgtaaaatttatattgctatggcaaaggatattcgcgttattttgattaaatttgcagatcgacttcataatatgcgaacattacaatttatgccacctcataaacaaaaaagaatttctcgagaaacgttagaagtttatacaccaattgctcatcgtttaggaatcaatgatatcaaaacagagttagaggatttaagcctatcttatcttgatcctgttgcatatagcgagatatcaaaattattagcgactaaacaagaagaacggaaagaatcagttgcaaaaatgatggcatcggttaaacaaatattggatgataatagctatcagtatcgtatcttgggacgggctaaatcaatctatagtatttataaaaaaatgtttgtaaaaaagaaacgttttgatgaactttatgatttatatgcattaaggatcatcactcaagataagatggattgttatggaattttaggcttgattcatgatcaatatcgcccgattccaggacggtttaaagattatattgctatgccaaaaccaaatatgtatcaatctttgcatacttcagtaattggtgaggatggaaatacctttgagattcagattagaactgaagaaatggatgagctagctgaattaggagttgctgctcattggcgctataaggaaaataaaggctattcatcgaagaaagaacaacaagaaattggtgaaaaattgcagtggcttagagaatttatttctctaagtgacgatattaaagacggtgatgctaaagagtattatgattcattaaagcgtgatatctttgaggccaatgtttatgttttaacaccgcaaggaaagatcgtagagttaccgaatggttctacaccaattgattttgcttaccgaattcatacggaagttggacataaagcagttggagctatcgttaataatgttatggtgcctattgatactaaattaaatactggtgatgtagtcgaaattaaaactaataagcagtcattaggacctagtgaagattggctaaaatttgttcgaactgcaggtgcgcgtaataaaattagacaatttattgctaatcgtgaggcagaaactaaaaaagagacaattgaagatgggcgtaaaatgcttcgtgatgaattgaaaaaacgccaattagatgaaaagaaatatatggatccagatacgtataaaacatacttaggttcttttggtgcccgctcatttgatgatatcttatattttattggtaaaaaaagtttaccggcaatgaatctgctggatcgagttgtacctaaaaagtcggggttctttgacagtatttcgaaaatgcttcagcgaaataatcaggtaaatgaaaaacagcagtcttcgcgtaataattcgggtgttgttgttaagggattagatggactaagaattcaactttcaaagtgctgtaatccaattcctggagatgatattatgggctttgtctcacaaggtcagggaattaaagtacatcgtcgagactgcccgaatattcaacagcctgaaatcaaagcaagattgatagatgtttattgggattttgcatccatttcaacgatgaaatttcaagcagatttagaaatagttggtttggatcgacctaatttattgaatgatgtggtaacatcattagggcagatgaaaattaatattttgaatatccatgctgatgttgtagatatgaaagcaatcattaaattaaagatttcagttgaagatgctagtcgtttacaacaagcaatcgataatattgatcggattcagggaatctatgaaattaaacgggttattcattagttattgcaattttatgaaatattatatataatcaatttaatccaatgaacaagattaagtagttaaatccttttatagagagaatacgtctggtgaaagtatttaaaggatcattacgggacacttgggaggagttactttgaaatctagtaggagtaaacgtctgtcgcgttaagacataagagcgtgttatttaacacgaattaaggtggtaccgcgttaactaacgtccttattttaagggcgtttttatattatcaaggaggaaatgaaagatgatgtataaagcaccacgaggaacagtggatattttgccagaaaagagtgctaaatggcaaacattagaacaactaattagaacaatatgtgctaattataatgttaaagaagtgagaactcctatttttgaacacaccgagttattcactcgtgcagttggcgatacaactgatgtagtaagtaaagaaatgtatactttcgctgataaaaaggggcgttcaattacattacgacctgaaggaacagctggagttgcgagagcttatgtagaaaataaaatgttttctaatcctgataaaattagtaaattatattatattggaccaatgtttagatatgaacgtcctcaaaatgggcggcaacgtcagtttcaccaattcggggtagaaatgattggttatgaatcaccatatttagatgttgaatgtatgacaatggcagtaacattagtcgaggctttagggttacaaggtgtcaaattacatataaatactcttggtgatggtgatagtcgtgatgcttatcgtgaagctttgaaagcacactttgcaccatatttagatgatttatgtcaagattgtaaaaatcgttatgaagcaaatccgttaagaattttagattgtaaagtagatcataatcatccagcgatggcaaatgcgccaaaaacagttgattatttaagtgaagcggctaaggcacattttaccaaagtatgtgagttattagatgatctagaaattgaatatgttgttgatacaaatttagtgcgtggtttagattattactgtcatacagtttttgaagtaatatctgatgatccacgcttaggtgcaggagccactgttggtggcggtggtcgttataatggcttagtacaggaattagggggaccagaagcacctggagttggatttgcttttggaatggaacgattattgattgctatggatgaagaattagaagaacctgaggggttggatgtgtatgttatgccaatgggagatgaagcaagagatttagcggtacagatcacggcaatgctacgagcaaatggctttagtgttgatatggactatcaaggtcgttctttaaaagcacagtttaaaacggttgatcgtttgaatagtcattttgcaatgatcattggtgatcaagaaattgctgacgaagtagtcaatattaaatgtacacattcaaagacacaagatattgtaccaattgaaaatattgttgcgtatattgaaaatcatatggagggacatgtacatgaatagaactcataacaatggtgaattaagaattagtgatgttaataaaattgttgaattaaaaggctgggttgctaaaaaaagaaatttaggttctttggttttcattgatttaagagaccgttatggaatcacgcaaatcgtattaaatgaagaaatggaagctctaggtaaggatattaaaaatgaatatgtcctgcatgtagttggtaaagtaattgaaagaagttctaaaaatcctaatatgccaactggggatattgaaattgaagctgctcaaattgatattatcaatacggctaaagtaacacctatttacacaactgatgatactgatgcaagtgaggatgcaagaatgcaatatcgttatcttgatttaagaagaccggtaatgcagaataaaataattatgcgtcataaaattactagcagtattcgaaatttcttagataatcatgaatttattgatattgaaacgccctatttaaatcgttctactcctgagggagcaagagatttcttagtcccttcacgggttcataatggttcattttatgctttaccacagtcaccacaattatttaagcaattattgatggtttcaggatttgaacgttattatcaaatcgcacgctgttttagagatgaggatttacgattagatcggcaaccggaatttactcaagttgatgttgaaatgagtttcatgactactgatgaaattattagtattggtgaacagctgttagcacaagtaatgaaagatgttaaaggaattgaactgcaactgccattgccacgaatgacttggcatgaagctatggaaaaatatggaattgataagccagatattcgttttggattagagttagttaatttaaatgaagtggttaaagatgttgagtttatggtttttaagagcgcgttagaagctgatgggcatgtaaaaggaattaatgtcaaaggtgaagctgacaatttttctcgtaaagcaattgataaattgacggatgtagttaaaacatataaagcaaaaggattagcatggttaaaagttaaagctggaaaggctgagggaccaattgctaaattctttaacgaagaacaaatgacaaaattattaaaagcaatggatgcaagtgataatgacttattattatttgttagcgatgctaaatataatgttgtttgtgatgctttggcagctttacgtaatcatttaggaaaagaattaaaattatttaaccctgatgaatttgcatttttatgggtcgtagattttccaatgtttgaatatgatgatgaaactgaacgttattatgcggttcatcatccatttactcgacctaaagatagtgatattgataaaattgaaaacgatcctgcaaattgtttagctgatgcttatgacattgtattaaacggttttgaattgggtggaggttcacaacgtatctacgaacaagaattacaagaaagagcctttagagcattaggttttacccaagagagaattgatagtcaatttggctggtttgttgaggcctttcaatacggtactccaccacatgggggatttgccttaggtctggatcgtctagcaatgttacttactggtagtgaaaatattcgtgaggttattgcttttccaaaaaatgcaagtgcagtatgtccaatgtcaaaagcaccaagtgaggtagataatgctcaattagaagaattaggaatcgcggtgattgaagatgaacaagaatagaattgatgcagttgtaaataatatgaaggaagctggtcttgattatttgttgatcagtgaaccttcttcaattgattatttgattgattatgtaaataaccccggtgaaagaatgtatgtattgatgcttgcagcaaatggtgcccataagttgttcttcaataaattattctttgtagaaaatgatctagggattgaaattgtttggcatagcgatactgatgatgcgacaaaaacaattgcagattatgttgaaaattctggtacaattggagttgataaacattggagtgcaaactttttattaagtttaatggaaaaactaccagatgttaaatttgttaatggctcattttgtgtagattttgtaagaatggttaaagatgaaaatgaacaggttttaatgattgaagcaagtcggatcaatgatcaagcaattcatgaagtgattcatcaagtatctttaggattatcagaacttgaagtagccggtaaattgagtggtatttatagcaaatttggtggtgatggcaacagttttgatgctatcatcgcttatggagctaatggtgctaatcctcatcatgaaaatgatgatagccatttaaaaccaggtgacagtatcattattgatatggggtgtaagtataacggatattgctcagatatgacaagaactgtcttctatcaagaagtaagtgaagaagctaaagaagtctatggtttggttcgtttggctaacgaaacagctgaagcaatgattaaacctggggttagactttgtgatattgataaggctgctcgtgatattattactgatgctggctatggcaaagaatttaatcataggttgggtcatttcattggtaaagatgttcatgaatttggtgatgtttctgttaactttgatttggaagttaaagaaggtatgattttttcgattgaaccgggaatttatttgccaggtaaatttggggtgcggattgaagatttagtcatggttacaaaagatggctgtaaagttttaaatagttatccaaaggatttatttgtaatttaatgattaagggttacagctcttaatcattttcttgtcgaataaaaaaacatactttttagggttcggtcaatacatttatcttaaattgtgctaaaatggtgaagtgaggtgacataaagaatgtattattttattggaattaaaggttcagggatggcgccattagctgaaatccttcatgaactaggaaatgaagtgtgtggaagcgatattgataaatacatcttcattgaagaggaattaagaaagagaaatatcccaatctattcatttgatgctaacaacattaaagatggttatacagttattattggaaatgcttttggtgatgatcacacagaagttaaagctgctttagctaatccgaatgttaaatgttatcgatattttgaatttttgggagagtttatggaaaacttcatctcaattagtatagctggaactcatggcaaaacaacgacaacagggatggcttatcatttgtttgaagaatttgataaaactacagttttaattggtgatggaactggtcatgcagtaaaagatagtaaatattttattgcagaatcatgtgagttccaagatcattttttacattattatcctaaatatgcgattatcaataatattgaattagatcatgtcgattattttggaaatttagagcgttatattgagtcttttgaaaaatttgctaatcaagtaaaagatacagtaattgtttggggggatgatccaaacattaaaaaaataaattttaaaaaaagagttatgagatttggtttaaatgactataatgacgttagggcggtaaatgtgcttgaaaacagtaatggtttatcgtttgatgtatatattcataatgaattatttggtcattttaatttaccttattttggaatgcatatgttgtataattcattagcgatcattacgcttggttatttagaaaatatgactaatgattatattcaaaatagaatggcaactttcgagggaacaaaacgacgatacagtgtaactgaagtagggaataatgtttacgtagatgactatgcccatcatcccactgcaattaagtatgtaattgaagcaacccgtgttagatatccgagtaaaaaaattgtagcaatttttaaacctgatcgtttttcacgtggcgctcgttttgccgttgattttgccaaatctatggatttagctgattatccatatttctgtccatttcccgaaaatgcagtgaaagaagaaggaattgacatagatatttatgatatcgctaataatctaccaagagcaaaagttattggtgaagatgaagaagctgctaaagaattagctaagttcgataatgttgtgttcttgtttatgtctagcaaagatatttataaacttgaagaaaaagttatcgcgataaaaaaatctatataagtatctagaattatggtataattatttgtagaaagttgaggtaatgctatgactgcaattgatgtttgttactgtgttttaatactttctggagcatttgccttagttagcttaggaattttattgcttcgtagttcaaccacagttaaacaagtggggaacacagtcgaaatggctcaaagcacaattaataaagcggataaaattatggatgatataacttacaagttagatcttttgaatgcgccagtagaaacaatcgcgcgtttctttgatccaaatcgacctaagtttaatcctataagtgctattattggattgttcaaaaagaaattttagaaaggtgaaataatgatgaaattaggaaaatttattgccggtgtaggtatcggtgcagtaattggaatgttatgtgctcctaaaaaaggtagtgagctaagaggtgaattaaaagaaaagtctcaagatctatatgataaagctcaaaacatgactaaagatgatgttgaatctttgatcaacaatactatcgaagaaatcaaattagcaattgatgaatttgatgttgatgaatttaaagatacagcaggagaaaaattaggagatattaaaactaaattagaacaactagcaacttcggtaaaatctagtgatgaatacgcaagttttaaagaatcggttgctaaagttagtgatgaggttacaacaaaatttaaagaaatcaaaacaaaagttcaagacaaagattttaatgtgttacaagaattagatgatgcaatggatgatattgaagatgaattagatgtcatcattgaggatctaaaagattaatgaaaaaagtaactatttatgatgtcgcaagagaagctggtgtttctcttgcgactgtttctcgagtaatcaacggttcaaatgttgttcgagaaaaaacaaagcaaaaagtcttggatgttattgatcgtttagatttcaaaccaaatgatattgctagaggattggctactagcaaaacaacaacaattgcaatcgttttcccacaatcactatttgctcatgtcaaagatatgattggtggaattggcgatactggtagacatttagattataatatcaatatgtatacgactgatgatattggtgatgaaaatacagttgctgatgttactgaaagattagtaaagtcacgtgttgatggagtaatcttatttaataatgataatattgacgaaactgttgaatcgattgtgaagtataatttacctatcgttgttatcggaacaaaaatgtctggtgaaaacattggttctatttatattgatgttaaaaaagctgctgaggagattgttgataaatatctagctaaaggtaaagatgacatagtctatatcttaccaaaacaaaatttaattaaaagtgatgaaattattgaaggaatcaaggatacatataaaaaatataacaaagagtttactaccgatcaaattgttacaagctctagccattatgaaaatacatatccgaattttgttgaatattttaaaaatcacaaacatgatttagtattctgtggatatgataaagacggtgttgcgattattaatgcagctcaagaaaatggaattaaaattcctgaagaaatggaagtagtaggaatgctgaatacaagttattcaattatgtgtaaaccgaccctttcatcaatgaatgtgcctgtttatgatatgggtgctttagctgttcgtttattaactaagttcctacaagatgaagaaattacttcaaaagaaattgcagtacaacatatgtttattaaacgcaattcgacaaatgactaagactttcattatgaaggtcttttttttgtcacgatttataattttcaattgttatttagatgaagggaggaaatttaatggaggaagcaatgttcgaacacctattccaaaagtataaagatatgatatatcgagtcgcttttctttatctaaaaaatgaggcagatgctttagatattgttcaaaatacatttattaagctattaaagaaaaatgattttaacgatgaagagcatcttaaaagatggttattaagagtttgtattaatctttgtaaaaataatttaaaaagttattggaaaagaaatgttagtgtttttgaagaaaaattttatcaattagaaaatagtgatttaaaattgcaagaactagtttttaaactggctcctaaatataagggagtgattcatttgtattattatgagggatattcagtgaaggaaatttcagtcattttaaaaattagtgaagccgctgttaagcaaaggttaaagcgagctcgtacaaaattgaaaatagaactggaggcagaatcatgaagaataatgattacaaaaagattgtcaatggaatcaagataccagagcaaaagcttgatctagtaaaaaatagtattttacagaaaaaaagcatctgtaaatttaaatatgctacagctttaatcgtgatagcagctatgatcacgggaacaatttattttagaacttatccaagaggagataatgaaacaaaaacattaatagatgttgattacttcattacaaatatttatgctaatgatgaaacctatgaattaacagacgataaagttagtattgacatgagtagtgatatgtttggaacaacctggagatgtaatgctaaacgctcatgtttaccatttgatattcgtattgttggtgaaaacattaagagtatcagctattctgtaattaaggggacgagcttagatttttatcgggttaaatcattagatttatttcatgatgatttatcggagttaaataaaaaaaatgattttagtatccaatttaaaatgtttaacgaattacgtgatcaagataaagaacttttaaaagaacgctatcagttaacagaagaaaatttagaatcatacgttaatgatcatatcattgatattattaaagattaccgtgcagctttagaacaagcaggctatagtcaggaaagcttaaatatgtatggcggacttttttggatagaaattaaccaaggcgataggatgactgttccttatgatcagcaagatcctctaaactatcgaaatattctttatactgaattaaatttagaaaataaagatatttcagtaatagataacgaacaaataatctatcaaacagttaaacaggaattattaagctatgaaataagcatggtaatagagtataataatggtgttatcaaagaaaaaataattacttttgaagaaggaacttgtgaagaaagaaataatgaatgtagggatactatttatatgaaaataaagtaaatcattaaaattaaatatgattaaaatatttaaatagtatcaggaacgataagttttgacaaaactattagggtatgttgacttatttaaaaatatagcatataattctattacgacgttgaaggaaaatagtaatcaaaataggcattttagagaccttgtggctggtgtaaacaaggatgtactactgatgaatacactctggagtttctaggtgaaaagtctagacgggtagttccgttatgaatgatgagtgcatgtattttatacgtgaataaaggtggtaccgcgagatttcgtccttttaggaagaaatctctttttattttataaatggaggataacggatgaagatttatgatgaattagtatggcgtggattaatcaaagatgttagttcaccagatttagaagaaaaattaaataatggtgggatgactttttatattgggactgatcctactggtgatagtctccatattggacatttttcatcatttttaatttcaaagcgattaaaagaagcgggacataatccaattttattagttggtggagcaaccggattgattggtgatcctaaaccagatactgaaagaccaatgattaccaaagagacagttgaacataattttgcttgcttaaagaaacaagcacaagatttgtttggttttgaagttgttaataattatgattggtcaaaggatcttaatttcattgattttttaagagattatggaaaatattttaatattaactatatgttaaacaaagatattgtaaaacgtcgtttagatgcagggattacatatactgaattttcatatatgatcatgcaagcaatggactttgaatggttatacaataacaaaaattgtgttatgcaagtagctggtcaagatcaatggggaaatattactgctggaattgaattgattcgcaaaaaagatggtaaagaggcatatggttttacaatgccattattgactaaaagtgatggaacaaaatttggaaaaactaatggtaaggctatttggctagatagagagaaaacatcaccatatgaaatgtatcaattttttattaactcagaagatgataaagtaattgattatttaaaatttttaactttcttaacacctgaagaaattatggaattagaagaaaagaataaaacgcaaccacatttaagagaagctcatcaagcattagcgcgtgaagtaatcacattcttgcatggtgctgaagcttatgaggaagctgtaaatatttcaaaaatgttattttcgggacaaattcaatcactaacattagcacaggtcaaggtttgctttgaaggtgtaccaagtattgaagttaatgaagaattgaatattttagatgcactaactacttgtggggcagcaaagagtaaacgagaagcgcgcgaatttgttaatggcggatccattttaataaatggtgaacgaattaaagatgttgagttcatagttacaaaagctaatgcatttggaaatgaggcgactgtagttcgtcgcggcaagaaaaattattttgtaattaagcatatttaaaaaagtaagttttataacttacttttttcttggcgtttttttccataacattgtattttcttcgtttgttaaactggtaaggagattgcttttagcttgcggatattttaaatatagatcatttagtaaatgtttaaattcttctcgtttagtatgcttatcagctggacatgttgaagggacaataggaacatgtgcttcttcaacagcactaactatatctgattcgtaagcataaactaatggacgaataaagttcatttcagttcttgttaaatacattttgggggtaaaggttgcaatcttaccaccgtagatcatattcataaatagtgtctcaacagcatcatcaccatgatgcgcaaaggcaactttgttgcatctgtatttctttgcaccatcgattacaagtgcttttttaaatttagaacataatgaacattgtagacgaccatcatcggtcttatttaactttaagatttcatatacatcactaggttcatgataaagttcaataccattttttttacaaaaagcatcagcttcactaaaatccatatttgggaagcccatttcaatatgtactccaataacatcaaattttacagttgcgaattttttatataatgataagcagtataaaaggagcatagagtctttaccaccagaaacgcccacacatactttatcaccatcttgaattaaattaaattcttcatcggctttacgaatacagccaagtacttttttcattgtcatttttatcaccttgctatattctaacaaaaatatcattactaagcaaagttatttgcaatttaatgtaaagataggtacaatgtaaagcggtgatgaaaatggatggaattattttagtaaacaaacctagtggtatgacaagccatgacgtggttaataaattaagacgaatattaaaaacaaaaaaagtggggcattgcggaactttagatcctgatgcaactggtgttttagttgtgtgtgtaaataaggctacaaaagttttgcagtttttaacaagcgaaagcaaagaatatgttgcaacacttagtctaggaacaagtactgatacatatgatgctagtggtaaaattattgaaacaaaagagttccatgcccttgataataatgaaatagttgcttgtttcaataattttattggttctcaagaacaaaagcccccaatctattcagcaattaaagtaaatggtaaaaaattatatgagtatgctcgtgcaggagagcaggtagaagtgccaacacgatcagttacagttaatcatttagaaatattacaaatcgaaaataatttaattaaatttaaagtgggatgttcgaaaggaacatatattcgttctctatgctatgatcttgcgaaggctttaggttatccgggacatatgaaagatttaattagaactaaatcaggaaatttttcgttagaaaattgttttacacttgaacagattgaaaatggtgaatacacaacagtaagtttagaagaagctttaaattcatatcaacaattagttgtagatgatgaaaaaataatttttcatggaaaaaaaatcaaatcagatttaaatgaacaggttgttatcttaaatcggcaggggaaagttcttgcaatgtatggccctgatggaaatggttatttaaaaagtattagaggtttatggtgatgaaagtaatatatttgaatgaagaaaatatgattgctttggaaccaagttgtgttgctttgggtttttttgatggcatgcatctaggtcatcaaaaattgattgatgaagtattaaaagtgtcaaaaataaagaatctaaaaaaagggctattaacatttgacgttcatcctaaatcatatcttttagatagttcttttaaatatttgatgagtctcgaagataaaatagaatttctagaaaaattaaattttgactatttatttgtattacgtttcaatcatcaattagctagtaaggaaccacgacagtttattgacgaatttattattaaaccaaaaatcaagcatgttgtttgtggttttgattttcattttggaaatcatggtagtggcgatagtgtttatctaaaaaataatagaaataatgattatgaaatttcaattattgataaattagaatatgaacagcataaaatctcatcttcatatttacgacaagttttaagtaatggtcaagttgaattggctagtcaattgttaggtcggcaatatcaagtgactggaaaagttgttcatggacgtgaaaacggtcgtaaaattggttttccgacaattaatgtggcagcaatagattatgtacttcctaaaaatggagtgtatggtgctaaagtaatcatcgatggtaaagaatatataggaatggcaaatttaggctataatccaacctttactgctttgaagcaagcttcattagaagttaatattttcgattttgatcagaatgtatatggaaaacaagtaaatgttatgtttattaaacatattcgcagtgagaaaaagttcccttcaataaacgatttaattgaacaattaaataaggataaacagcagataattaatgaaatgatatgattagtacatatcatttttttatgttgctttcctatatttattagttttatttatgaatatctggggaataataaatttggtgatatgatgttatatggatggttaatcttttctagttttttatggggtaccaacgttcttgtaatgaaatatatgttagaaaacactacaacatattttttagctgctctaaaagtactgttgtcggttattgcaatttttgtaatcatgaaatataaaaaaataccttttaaatggtataaaggcagtctaggaataaaggtatcattactttcgattacaattaattttatacttacctttgagggattgaatttaattaccggaagttcaaatgcaattgttaattccttagcaccgctagtgacaatcctattgacatggcttttttatcatactaaggtcaatcgttaccagttgattgctatgataatcgcatgcattggatttcttatttctctagattttaatattagtcagatttctcttggtcatttaatgatgattggtggaattgtgttatatagttatggtaatttattaatgcagcaccaatgtaaaaaagaagacagtttgccttttacatttcaatatttatgtttgagcttctttcaattagcgttaattactttatttattcctagcagcaatcatcttgaaaatatttcaataactttatgggtatttttcataattttttctggaattggatttgctataattcaattaacgtattttcgagctgttcacgaaattggaagtgttaaaacaagttttttattaggactaaatccagtgtttacatatattggttcattgttactacaagaaaattttaattttaataaatttatggcgatgattttaatggttgtagccatggttattgcaaacaaaaaaagatagttagttcataactatctttgataatatttaataagagcttgagtgcctaagttctcaaatccgtcggtttgtaattgttcaaactgttgtaaaacagtatttaaaacttctaagtcaaggttgtttgtatcattaacagctttggctattttcatatctttgatataatgttttatgtaaaaccccggtgcaaaatcatcagcaagaattcgtggggcattattagtcatttgccatgaaccagcagctccactcgaaatacagtcaagcattatttgagggtccaaattgactgctttagcatatgtaagagcttcacaaactccagctaaagctccggctaaagcaatttgattggccatttttgtatgttgaccgtttccggctgaaccaacataattaatgttgcttcctaagacttctaacactggttcaatttgtttaaagacattttcatcaccgccaaccataattgacaatgtcccttttttggcaccaatatcaccgcctgataccggagcatcaagactggctaaactatgttttgaagattcttcaaaaattttttttgctaacaatggactagacgtagtgaaatcaatgagaatacaatcttttttagcattagcaattatccctttggaactaaagtagatttcctcaatatcttgaggaaatcctaccatagtcatgacaatgtcttgatctttgacacactcagcaactgaatcgtgccatataattttatcactaataagatcttcaactttattttttgttcgcgtataaatagatacaggatatcctgcttgactcaaattttgaaccattgctttacccattactccgaccccaataaatgcaatttttttcatttttcttcctccagtaactctttatataatttaattaaatctgcttgaattttatcatgatttttttccggatgccattgtacagcaataatattatctttttcaatgccttcaataattccatcagcagtaattgcactgacaacaaagccaggggcaatatcatcaattgcctggtgatgaaatgaattggtcataaactcatttcctaaatatttatttagttttgtatgaggaatagttttcacgagatgatgatatccttctaaattttcctggagatgattatcatatttttttgtctcaggaatatcctgaatcaaagtaccgttaaatgcaacattgatagtttgaattccacggcaaatccctaatataggtttatgagcttttgaaaacttatgaatcaacttaatttctaattcttccaattctgcttcctctttattggttagaggatttaatacttgatggtataaaacgggatcaatgtcaaatccgccgcttaataatagaccatcacagtgagtgactaaaaaatctagtgtatcatcactgctcggtccaataataataggatctagatttgcagtttgaagcattctaaaatattcacggtaaatataataaactctgcgttgagaatagcttcgcattggcgttaagatttttttattcataaactacctcctgtatttatatattacgcgaaacaaaaataatgtaaagaattataaaaataatttaaaactgcacagatattacttagacatcatatgacacttatgatatactttattagtaagatttataaaaaagagggatgtaatataatggactttttagataatatattaaaaaaatttggaacaaaaaatgtaatcatagtaggggtagtattaattgtaactattgtgatcttaataacatactggatgattaaattaagaatatatcgtaaagaaattgtggttttagaaaatgatatgaatgcaattaaaactttgccaattcaataccgcttagggcggattaaagcaattggaaaaaacatgccagatgttttagaaaaatatgatgattttgaactagaatttaatgatttagtaaatctacaaagtaatgaaattgcgccattgatcaatgatattgatgagcgattgttttatcgaaaattaaaaggggttcgcagagatctaaataaattaagacaagatattgataattatgagaaacgttctaaggcgttgcttaaagaaattgaggtgatcactgaaatagaaaatgtgcaacgtgtagaaattattaaaattaaagagaagttccgtttaacaaatgatgaatttgctgctgtacgttttaaaatagaagattttgtacctgctattcctcaaaaatttgcagatattgaagaacgctttgttcaattagaagcattgatgaatagtcagcgttttgatgaagctaaagtatcagcagataaaattgataaagacattgatttattaagtgcttatcttcgtgatttaccaacttatatttcaattgttcgaaaatatattcctaagcgattagatgaattataccgtgttattactgaaatgaaagaacgtgatttttcaattgaacgtcttaatacaacagttcgctataataagatcaatgctgatctagaaaatacgatccaagctattaaagagttaaatctagaaaatgttggtgcttccattgaagtaatgacagaagatctaaattctttaacggcagactttgaaaaagaggaagctgcatatagtcgctatgaggaatcacgtaatgcttgttacaaacatattgggcatttagatgaaggccttcgaaatactattaattctttaggtgaacttcaaaggaattatttattatctgattatgaaattactgttaaagaagattatgaggcttttaaagggattttagatgaattagatcaattaacagtaataattgaaagcaatgatttttcatatagtgtcttgattgagcgttttgaagaattgattgatcgttgtaaaccttttgatgagtctttgaataagtatattgaattagaaaattctttgagattacaagaaaaacgtgctttagatgagttagataatattaatattgtcttactagaaataaaatcggagattaaaaataaacatttaccaatgattaatgaatcttataaagattatattgatgattcttatcaaaaagcggatgaaattttgaaatttatcagacgtcgaccaattgatttagagcgtctctcagttcaagttgatgctgcacgagatgtaatctataaattatatgataatgttcataatttgattgttactgcagaaatggttgaagatgcaattatttatggtaatcgttatcgtagttcttttttagaagttaacacagaattaactaaagcagagctgttatttagaaatggtgaatatactaaagctttgactactgcagtagatattattgaaaaaatcaatcctggatcatatgagatgttgattaataaaaatagtgcaaaatcataagattttgcctttttttatgggtgagagtataattatgaagaatgtacaaggtattatagtttaaaagtaatataatggggatattaaagcttattaataaaaataggagataaaaatgaaaaaattattaatttggggtgcaggagatcaaggacttgtgactcttgagtgtgctttagccatgaatgcatatgaacaaattgattttttagaaatcaaagaaaaaggaagtagaaaaataattaatcatactgtatttaaagaaagtgaattcgataaagtagtaaaattatatgatgaggttattgttgcaactggtagcaatgatttacgagaagaaaaaataaaaatgttacttgcttttggtattcctttagcaacgatagtccatccaacagctttaattagttcatctgcaaaaattggtagtggtacaacgatattggctaatgtaataattaatattaatacaaaggtcgggattggctgtatagtcaataatggagcaattattgaacacgattgtatggtaggaaattatgttaatatttgtcctaagtttgcgatggcaggtcacagttcgattggatataaatcttatctgggaataggtagtactgtcattgatgatattagaattggtaatcgggtaacagttggtgctggagcggtagttgtttcaaacatttctgataatatcgttgcgattggtgttccagctaagaaaatgctggtggataagtaaaaagtgttgtgttaaaatatttaagataattacaatttgatggtttacgttggttttataaaagtaattatataggaaaattaaagtactttggaattgcaagtaagaaaatgattttatttctttactttcgtagtaaatattgtagaattatttaatgttgtttgaaagatattttggtggagtcataagactttggatttttattgcatataataatgtagggggttacgatgatatatttagattatgtggcaacaacgccattaaattcagaagtgttaaatacttatcataatttattatccaattatttttataatgctgattcaatgtatgataaaggtattgaggtaaatcgtttgatggaacattcacgtaaattaattagtgagtccttcaaagttaaagaagatgaaattatttttactagctgtggtagtgaagctaataatatggcaattaaaggtacagcctttcaatatcaaaatcgtggtaaacatattattactacagctattgaacattcatctgtttatgaaacttgtaaagagttagaaaagttttttggatttgaggtaacttatttaggggttgatcataaagggcggatttctttagaagaattagaaaaaagtattcgtgatgatacgattttagtatcaattatgtatgtaaataatgaaattggggtcattaatcctattgatgaaattaaaaaaattgttaaaaaatacgataaggtaaaactgcattttgatatggtacaggctttaggaaaattaccaatcgatttaaatgatgtggatttagcttctttttcggcacataaaatttatggtttaaaaggtagtggcttattattcaaacgacgttcaacgacaattgttcctttaattagtggcggacaacaagaatttagtttacgaggtggaacttctaatgcctgtactaatattgtttttgcgaaaactttaagattagcattagataattttgaacaaaaaaatcaacatattaaagatataaatgattattgtcgaaaatgtttacaggagatagaaggaattgttattaatagtgatgaaaattgctgtttaccatcaattttgaatttctcatgcttaggttataaaccagaagttattttacatgatttggaaacaaaagaaatatatttatcaacgcgtagtgcttgttcatcaaaaacgagcaatgtttcacgagtcatggcgcaattacatttagatgaagcaattagttctagtgcgcttagaattagttttggagagcatactacaagagaagaaatcgatcggttttgttattatttacaagaaagtatgcgtaaattaaagaagcagaggtagaatatggaagcaaattatattttagtacgttttggtgaattaacaacaaaaggtaaaaaccgtaaattatttacgaatcgtcttttaaaaaatactaaggagatattagcagaatttaatcatttaacatatgatttacaacatgatcgtatgtatgttgttctaaatggtactgatcatgaagctgtatgtacgaaattgaaaacagtatttggaatctattctttttcagtagcatataaaatggaaaaaaatctcgaattagctaaacaagcggttttacaaataattgaaaacaatgatgggaatacgtttaagattaatactaaacgttcagataagaatttccctggaagttctcaagaaattaatcgtgaaattgcaggatatgtatttcatcacactacaaaagaaataaaagttgatgtccatgctccagcaattttagtaacagttgaaattcgttatgacgcgatatatgtaatggataatattattaaaggagcaggtgggtatccagttggagttggtggaaaagcattattgatgatgtcaggaggaattgattcaccagtagctggatatttaacattaaaacgcggtgtagatattgagtgcatccattttgctgcaccaccttatactaatgaattggcacgagaaaaagtttttgatttagttgataaattacgtcattatactcacggttcaattagagttcatgtaattaattttacaaaattgcaattagctgtttatgataattgtgacgaaagttatgcaatgacagtcatgagaaggatgatgtatcgtattagtgaaaaaattgctaataaaaataattgtcttgcattagtcaatggtgaaagcattggacaggttgcttcacaaactttaaatagtatgcaggtaatcaatgaagttgttaagattccagtactaagaccagtattatgtcttgataaattagaaattattgatattgctgataggatcgatacttatgaaatttcgattcgccctcatgaagattgctgtactatttttacacctaaagctccggcaactaagcctaagttatataaagcggaaatatttgagtctgggtttgattttgaaactttgattgatgaatgtgtagaaactgctgaaattattacagtcgatcacaattataagaaaaacgacgatattttttaaaaataattaaaaaagcgtatatctttttttgtttgacacaagatattagtgtcaggaggtgaagatatatgtcacaaagtaactctagtagaaacaaattagttgttcctggagctaaaaatgcaatcgatcaaatgaagtatgagattgctaacgaatttggcgttaatttaggtcctgatacaactgctcgtgataacggttcagtaggtggcgaaatcacaaaacgattagtcgctatgggtcaagcacaaatgagctcatcaaacaaatacaatcaatctaaataattatttttaaaaccctagttagctagggtttttatctttaaaaaataaatttaaatttttttattaaaaatgtatattttaaaacaaatgacacaaaatattactgtcaggaggtgaaaatatatgtcacaaaataactctagtagaaacaaattagttgtccctggagctcaaaatgcaatcgatcaaatgaagtatgagattgctaacgaatttggcgttaatttaggtcctgatacaactgctcgtgcgaatggttcagtaggtggcgaaatcacaaaaagattagtcgaaatgggtcaatcacaaatgagttcatctaataactacaatcaatctaaataattatttttaagaccctagttcaatctagggttttaaaatattcttaaatataaaacaaatttattcgataattccaataaatactttaataaatggtgaaagtgctttcaaaatatattgagtttagtgttgaatttaggtacaattaatatatgacatgaagaaataggaggaattataatggttaaagtaatggcaatcaatgctggtagttcatctttaaaattccagttgatcaatatgcctagtgaagaagtaattacatcagggttagtcgaaagaattggactagaccaaggtaacttcgaaatgaaatataatggtgaaaaatttattaaagagtgtccaattaaagaccatagtgttgcagtacaattattattagatgctttagttgatcaccatgttgttgaaagtttaggtgaaatcgaagcttgtggacatcgagttgtccacggtggcgaatattataacgacgcggttaaagtcgacgaggaagttgttgctcgcgtagaagaattagctgaattagcgccacttcacaatccagcacatattgttggatataatgcatttaaagcagctttaccagaggttgaacatgtttttgtatttgatactgcatttcatcaaactcttgatcgggaaagatatttatatcctttaccatatgaatactatacagatttaaaagttcgcaaatatggtgcccatggaacaagtcataaatatgtatctcaagttgccattgatatgttaggaaatcccaaacattcgcgagtaattgtttgtcatttaggaaatggtgcaagcatttcagcagttcaggatggtatatgtattgatacttcaatgggatttacaccactggcaggagtaatgatgggaacacgctgtggtgatgttgatccatctattatgccgtatttatgtaaaaaattaaataaaacacctgatgaaattttagatatctataataagaaatcagggatgttaggaatttctggaatttcttcagattcccgtgatattgaaaatgcattatttaagaacggtgatgaacgtgcacttcttacaggcttgttatatgcacgaatcgtttcaaaatatattggaagttattttgttgaaatgggtggtgttgatgctattgcctttactgctggagttggagaaaatgcttcttatcttcgtcgtttgatcattgataatgtttcacgtgcgttaggcgttttcttaaatgaagaagaaaatgaacgtcgtagtaaagaaaatcgtctaatttcccatcaatattctaaagttgatgtttatgtaatccctactaacgaggaagtaatgattgctcgtgatactgtaagaattttaggtttataagctctgatcaataatcagagcttttctatttataaatttgggtaaatatggtatagtcatcttattaaatagaggagttttataatggaagaaaaaataattgctaaaattgaagaatatgattatattgctatttaccgtcatgtaaatccagattttgatgcttttggcagccaattgggaatgtacgatatgattaaagctacttatccagataaaaaggtttttttatgtggtgatttcagttcggaattagtgaaaaaatatacagtagtttttgaacatcaagaagttgattatactaaagatattttaggaattgttcttgatactgctaatattgaaagaattgatgatcaaagatatcaactttgtaaagaaattattaaaattgatcatcatttggtcgtagatagttatggcactttaaattacgaagatagtagtgctagttcagctagccaattagttggaacaatttttaaagatacggctatgaaaattactaaaagtggtgcagaagctttgtatttgggaattgttggagatacagcgcggtttatgtatcgaaatactgatgaacggacttttgcagtagctggagctttggttcaagaaggaattgatattgttgaaatctataatcgaatttatatgaagaaggctaaggatttacaaattaataaatttattttaaataatcatcagtttgatggtggtgttgcttattatgttttaagtgatgcagatttaaaaatgttagaaattagtcgtgaaagaggttcggattttgttaatttattatctggtgtagaagaatataaaatttggatggctctaactgaaaatgtcgctgatcataattggcgtgttagtttacgttcacgtgattacgcagtcaataaggtggctgaaaaatataatggtggtggtcatatgctggcaagtggcgcaaagttagcttcattagaacagcttggtcaactgcttcaagatttaaaggagataatcaatgaataaatttactgacatatttgcaaattttattgagggtttttcatttagacaaggttctcaagatgtaaaacaagtaaaaaaaggtgcttttttaaaggcgtttacaataactttaataattggattgattggtgaatatgcttttttgatcccattgaatcttcgttcaccacaatttataatttatttttgtatattattattaatatttaatggactatattttatgttaagtcaaagatttagtaagatcaccaaatatagtctcattgtgattggaatattaattgcatatgtggccattggaacatttgttagttcgcctatctttaatgcaggaagttatcaaaaacaattaaagttagataagaaagcagacttctatgctgacaataaaactatttcctatcaatcgattccagtggtggatcgagatagtgcgattaaattaggtgatcgtaaaatgggacagatggttgattatgtatcccaatttgaggttgatgagtcgtatgaacaaataaattatcaagatacgccatatcgtgtgacaccattagaatatagtgacttgatcaaatggtttactaaccgtagtgatggactgcccgcatatatccgagtaaatatggtgacgcaagaatctgaagtagttaaattaaaagaaggaatgaaatattctaaatcagaacattttggacgtaaaattgaacgtcatttgcgcgctaattatccaactttaatgtttgatacattggcttttgaaattgatgaaaaggggaatccttattggattgcaccagtatataattataaaatcggtttatttggtggaaaagatataactggagctgtattagttaatgcaataaatggtgatcatgaatattatgatattgataaagtaccagaatgggttgaccgtgcttatccagcagaactggttttaagtcaattagaaaattatggtaaatatacaaatgggtattttaatactttattttcgcaaaaaggagtattacagccaacctctggttacaattatgtagcaatcaatgatgatgtctatttatatactggtttaacatcggtatctaatgatgcttctaacgttgggtttgctatgattaatttgcggactaaagatggaaagtattataatatttctggagctgaagaatattctgcaatgtcttcggcggaaggtcaagttcaaaacttgaaatatacggcaactttcccgattttgatcaatgcgggagggcagccaacatatttcttatctttaaaagatgatgctaaacttgttaaaaagtatgcttttgttagtgttgaaaattatcaaatcgtggctaccggtgacagtgttgctcaagctgaacaagcatattatgctttattagaagctaatggtaaaaaaactgactcaagtgaatataagactaatgagttgactggagcgattactgcaattaatgaagctgtcgttgatggtaacagtacttattactttaaacttgaaggtagtgatacgattttcatcggagatatcagtttatctaatcaattcccattagcaaaagttggtgatgttgtaaccattgaatatgttaatagtaaagacaatagcgaggtaattacttcaattaaatttggttagtctttaatagaacaagaagctataacttatatataggttatggcttttttatatttattatcatctctttaaactcaagctattttgcttttgtaactatatatttagttaataaaatgtgttataatcttacagtgaattgaggtgtaaagatgaaagcaaaagtactagtagttgatgatgaaaaagatattagggaattaattaatttttatttgaataaagaaggatttgaagttctggaagctagcaatggtgaagaggctttagaaatattcgaaaatgaatatattgatttaggaatcattgatgtcatgatgccagttatggatggttttgaactagtagaaaatctaaaggaatttaaagatgttccagtaattatgttaacagcgaaaggtgaaagtaaagataaacttcgcggtttttctgttggtgctgatgactatgtagttaagccatttgatccaactgaattaatggcacgagtgcgagcagttttaaaaagatatagtgttaatacatcaaatataatcaaattaaatgaagttgagtttgatggcgataaatatgagatacgttatcagagcgaaatcattcatttaccgttaaaacaatttgaattagtttttgagttagcaaagcatccagatcagatttttagtcgtgaacagttgattgaaaaaatttggggaatggactatgatggctttgatcgtactgtagatgttcacattaagcgaattagagaaaatctaggacacttaccaggatttaaagttgtaacggtgagaggacttggatacaaggttgaagtcgaatgatgaaatctatttatggcaagctgatttgcggttttttaataactatcgcatttagtttttcggttgctggatatgtagctttacgtaataattatgatcaaattgaagatatggctaagagtgagttgagtgcaacaagtgaatatgttgtaggtattttaaatagccttgatgatgctaatattaacgatattatgaataaatacgcaattagctcagaggtttatataacgttgtattcaccagaattggactattatacatatggtgaaaacaaaggatattttcctagtcgcgagacaatgattcaatattatcatgatgaaaacaaaaacgggcgtttcgatgagcgcaaaagtgtgcaaacctatggcagcaaggcaaaaatcaatggttctgatgtatatatatttattcaaaaggatactagttatgaaaaaggaatttttgctaattctgctgttttgattttgggttgtgtctttttatcaggaaatctagtttttttagcgattgctgatattattgttaaaccaataacgagattaactaacgccactaaagaattatcaaaaggaaattatagtgttcgtgttaattatgtgggtgatgatgaaatttctcgattgaatcagggatttaatcaaatggcacagcagttagcgaaacaagaagaaacaagacaaaagttcatttctgatatttcgcacgaatttcaaactccattgactgcaattcaaggctttgccaatattttaaaagaggaagatcttcctaaagagcagcgtcaaaagtatgctgatataatcttatttcattcaaaaaggttatcgactctttctaagaatatgctgcagctgacgttgttggaacgagaagaggttgagttagaatttacaacatattcaattgttgagcaattatctcgggttatttctactcaagaaaaccaagcaattttaaaggatatagaaattcaatttgaaaaaccgcgcaaagatattatggtttatggcgatgaacaacgattggaacaagtttggatcaatcttatttcaaatgcaatcaaatatactggtgaaggaggtcttattacagtaactgttaaaaaggcttctcgtgaagttgaagtatcaattgaagatactggatacggaatgtctaaagaagttgtttcacatatatttgaacgtttttatcgtgaagaaaaagcccgttctgtagaaggaaatggactagggttatcaattgtaaaaacaattgtagatttacatcatggaaatatagatgttatttcccaggttgatgttggctctacttttgtagtaaaattaccaagcgaacgaaaagtttttgatattaaagaaaaactatcgtttaataaataatcggaggaatttatggaattacttaaagagagaatattaaaagacgggattgtaattatgccggatatattaaaagtggatagttttttgaatcatcaaattgatcctactttgtatcgacaaatagctcaagaattcaaaactcgttttaaagacacaaaaattactaaaatcttaacaattgaagcttcgggaattggaattgctttagcaacagcttttgaatttgatgatgcacctgttgtctttgcaaagaaagggactgcaaaaacaacaagtacacattattatagttctaaagtacattcatttactaaaggaattgattatgatgcgattgtcagtaaaaaatatttagataaagacgataatatcttaattatcgacgattttttagctaatggtcaagctgtattaggtttagttgatattgttaaacaagcaggtgcaaatattgctggtgttggaattgttgttgaaaaaggttttcaaacaggtcgccaattaattgaagaaaaaggctatcgtgtggaatcgttagcagtagtagaagcatttagggatggtgcggtgatcctgaaataatgagaggaagaaagtaatgtatttaaaaagaattgaattacatggttttaaatcatttgctgataaagtcaatgtagaatttcaacctggaatcacaggaatcgtaggtccaaatggttgcgggaaatcaaatatctctgatgctgtacgttgggttttaggagaacagtcagttaaatcgttgcgtggtgcaaatatgtcagatgttatttttgctggaagcgaagatcgtcgggcacaaaatttagctgaagttaccttagttttcgataacagtgatcgttttatgaaatatgattataatgaagtcgagattacacggcgactttatcgtatgaataatgaagcggagtatttaatcaataaacaatcttgtcgtttaaaagatattattgatttgattatggatacaggtctaggaaaggattcgttatcaattatttcccaaggtaatatttcttcttttgcggacaataaaccagaagaacgtcgtggtatttttgaagatgcagcaggagtttctaaatataaaaaaagaaaattagaatcgattcgtaaattagaacgtactaacgaaaatcttgaacgaattggtgatatcgtagtagaactagaaaaacaggttggtcctcttaaacgtcaaaaagacaaagcagagaagtatttagcgttgaaagaaaaattaacagctatagaagttaatgttttaataaatgagataactgaagcaaaaaaatcactagatgaattgagtaaggtaatcaaggacttaaatgagcgtcaagcttctttagaggctgatattttgcttaaagagagcagtaacgatgaaataaaaaagaaaatgtttactctcgaccaagaaataaatgctttacaaagtaaactattagaggcagtatcaaatgtctcgaaactagagactgccaaagtcgaagttgatcaaaagcgaaaacatgcacttgagaccttaagtaaagaaaatttaaaagaaaatatcgctaatatgaaggcgattttaagtgatgttgttaatgaatataatgatcgtgtggaacgattagataacactcaagaagagttaaccacgataattggacaacaagaggagcgtaataaaaaattacttttattaaaaaatgaaattgatcaattatcaaacaatattaataaaaataaatcacgaaaagagattttaatagatgcgattgaaaataaatcaaattatcatcatggcattaaaacagttttaagtcttgctaaaagtaataaaaatattattggtgttttaggtgatttaattacaactgatgaaggatatgaattagcgttgtcgtcagctttagcaggagcaatagagtttattgttacaacagatgatttaactgcacgagatgcaattaaatttttacgtgataataaagcgggacgagctacttttttaccaatcagtgctatgaaaccacgacatgtgcgtgaagaacatttagttgtttgtcaaaccatggaaggatatttaggtttggctagtgattttgtaacatatgaagatgagattgctgccgttgttttaaatcaactagggaatatcattgtagctaaagatattgatagtgctaatgaaatcagcaaagcaactttttctcggtacaaagtcgtttctcttgaaggtgatgttgttaatgttggcggttctttgacgggtggaagttttaatcgtcaaaaatcttcaatagttcaaaaacgtgaacttgagcaggttgctgttactcttgaacaacaagaaaaagaacttgggcttaagcgtaatgaacataatggattggataatgaaatcaaagaagtttcacatgctctattacaaaagcagatggcatatgctaaattggaagttgttgttcaaagcaagaaagaagagttgatcaaggcaaaatccgagtatgaatcattagctgatcaaagtgttgaattagaagaatttgctagtggaaaaacagaaagtaaattagttaatcagttaaatgaagcgattaaatatcgtgataatttaactgaagaaattaaatcaaaacgtgaacttagaatggcctatgttaatcaaaatgaagctttagatgttgaattgcgtgaatatcgtaatgatttaaaagaggttcaaagtgaggttaatactagtgctattaatgcaacaaaattagaagcaatgttaaataatcatttagctagattaaatgatgaatatcggatgacttatgagtatgctgtcgagcattaccttgatgaaattgatgttgaacaagctaaattagaagtatacgaattaagaacaaatattaatcgtttaggaaacgttaatgttgatgcaattgaagaatatcaaataatcagtgagcgttatgagaacatgaatactcagcgtatagatttgattcaagcccaagatagtatccttgaagcgattaaagagatggatgaaattatggttgagcgtttttcagaaacgtttgagaaaatcaacgaagagttcaatcatgtctttaggagtttatttggtggaggaaaggctagaataaagtatactgatcctacaaatattcttgaaactggaatcgatattgatgttcagcccccaggtaaagcagtccagaatattacattattttcaggtggggaaaaggccttgatcgctatttcatgtttatttgcaattttacgggtacggccaattccgatgtgtatcttagatgaggttgaagctgcattagatattgcaaatgttgaacgttttgctaaatatttaagagaattttcgggaacgacgcaatttattgtggttacccatcgtgaaggaacaatggaagaatgtgaccttctttatggagcaacaatgcaacaaaagggagttacaaagttagttagtgtcaaattagaagaagcaatagatttaacagatcaaagttaggaggaatcgtatgggattttttagtcaaataaaagaaaaattcgttggtaaatctgctaaacaaaacgaaaaatatgtagctggattagatcggtctaatagtactttttcagatcgaatcaatgaacttgcagctcgctttagagaaatcaatgatgagtattttgaagaattggaaaatattttgattatgtccgatgttggagtttcgatggtaatgaagatagttgaagaaattaaaaacgaggtacgtttgcaaaatattactgacccaaaagagattaatgagatcatcgttgataaaatgttcgttatttatgcaaatgatagtgtcatgacaactaagattaactatgctgaggaaggattaacagtaattttaatggttggagtaaacggggctggtaagactacaacaattgggaaattagctaatcgtatcgttaatgatgaaggtaagaaagtaatggttgcagctggagatacttttagagccggagcgattgatcagttagcagtttgggcacagcgtgttggtgtcgatattgttaaaggtaaagagggcggtgatccttcagcagtggtatttgatgctttaaaacaggcaaaagaaaaaaatgttgatgttttaatttgtgatactgctggtcgtcttcaaaataaggtcaacttaatgaatgaattagaaaaaatgaatcgtattattaaacgcgaagtacctgatgcaccgcatgaaacactgttagttattgatgcaacaactggtcaaaatggtgtttcacaagctgtggaattttctaagatcactgatgtctcagggttagttctaaccaaaatggatggaactgctaagggggggattgttctttctatcaaagatcaattgaatatacctgtaaaattcattggtctaggagaaagtgttgatgatttacaagaatttgatttagaccagtatatatatgggttatgcaaaaacctagttgaggaatagtatggaatcaagtttagagaaaaaacaacgagttaatctactaatggattgttatagtgatttgttgacagaaaaacagcaaacatatttagaatattactatcaagaagattactctttatcggaaattgcacaaattttggatgttagtcgtaatgctgtatttgataatttaaaaaaagcagttcatagtttagaaaattatgaagaaaaactgcagttgttaaaaaaacatcaagaaaggcttgacttgatccaaagaattgaagatgatatatctagtgatcataaaagtctagaagaatatttagaattattaaggaagatttagaaaggggtatttatggcatttgattcattatcagaacgtctgcaagggactttaaagaaagtttctggacaagggcgtttgactgaaaaaaatatggaagaaatgcttagcgaaattcgcttagcattattagaggcagatgtaaactttcaagttgtaaaagagtttattgctgcaacaaaagaaaaagcgttgggacaagatgttttaggttcattaaaaccgggacaggttgttgtaaaaatcgtccatgacgaactagtttcgttactgggaacaagtgttgcggaagttgattttgataagaagccaactgttattatgatggttggacttcagggttctgggaaaactacaacttctggaaaaatcgcaaaattaattaccaagaaatatggtaaaaaaccattgttggttgctgcagatatttatcgcccagctgctgtggatcagttaaaaacattaggtgaacaattgaatgttcctgtctacgaaaaagggacatcacaatctgctgaatcaatcgtagaagaagcgatgacatttgctcgtgaccataataatgacgtaattattatcgatactgcggggcgtttacatattgacgaaccattaatgaacgagctggctaatattaaaaagatcgctcatccaagtgaaattttactagttgttgatgctttaactggacaagatattgttaatgttgccagttcatttaatgaacagttgagcattactggggctgttttaactaaattagatggtgactctcgtggtgggggagctctatcaattcgtcatattacaaatgtaccaattaaattcattggtactggtgaaaaattagatgctatcgatttattctatcctgatcgtatggctgatcgtattttgggaatgggcgatgttgtatctttagttgaaaaagtacaagatgtatatgatgaaaaagatacaatgaaagcctataaaaagatgcaatcgggacaatttggtcttgatgacatgctttctcaaatgcagcagttaaggaaattggggccactatcaggaattatgaaaatgattccaggaatgcctaagttaccaaaaatgaatgatgaggactctgaaaagaaattaaaaatgactgaatcaattatcttttcaatgaccaaagaggaacgtcgagatccaagtattatcactttatctagaaaagagagaattgctaaaggttgtggtaaagatgttgcagcagttaaccgcttgctaaaacaatttgaagaatctaaaaaaatgatgaagatgttaggtaatgttgatcctaatacaggtatgccaatgccagggggacgtgcaaagaaccctaatatcggtaatcctaatcgtaaaaaaatccgtcataaaaagaagaaaaaatagcctgataaattcaggctttttattactaaaggagaatatgaatgactcaaaataaatatgatgatccagctttttttgaaaaatatagtcagatgtcgcggagtaaaaatggattagagggtgcaggagaatggcatgtattacaacgagttttacctgattttacaaataaaacagtattggatttaggttgtggatatggctggcactctatttatgcgattgaacacggtgcaaaaaaagttatcgcaagcgatatttctagcaaaatgattgaaacagcaagaatcaaaaacaatgatccgcggattaaatatgaatgcatttcgtttgaagaaagtaattttggagaagctgtatttgatattgttatttgctctttaatgattcactatttaccttcctaccaagattttgtaaaaaaagtaaataaatggttaaaaacaggtggatatttggtgtttaatgttgaacatcctgtatttactgctaaaggagatcaagactggtattataatgaagctggtgaaattgagcattttcctgtagataattattatcttgaaggaaaacgtgaggcggtgtttttaggggaaaaagtaattaaatatcatcgcacattgacgacttatttaaatgaactgttaaatggcggatttgaaataattcaagttaaagaaccaacggtaagttcaaatgcccttattgcacatcctgagtttaaggatgagttacgccgcccgatgatgctgattgtttctgctagaaaaaaataaacactgtcaagtaaaaaagcttgacaccttatctagagtatgataaatttagtgagtaaattaattaggaggatatgtatatggcagtaaaattaagattattaagaatgggtgctaagaaagctcctttctatagaattgtagcagcagattcaagagctccaagagatggacgttttattgaactattaggaacttatgatccacgcactaaccctgcaaaagttacaattaaagaagaagaagtattaaaatggttaaacaatggagcacaaccatctgatacagttaaaaacttactatctaaagaaggaattattaaaaaatttgctgattctaaatcaggtaaataatcatggattacgcaaagattcttaaagatatcgcgattgaattagttgaagataaagaccatttagaagtacgtgaaatgccgtcgttagaagaagatgtagtggtactacatgtttattcagctaaatcggatattgcgcgattgattggtcgtaaaggtatgatggctaattcaattagacagcttatgtctgttgctggtcgcatggccaataaaaaattagatattaagtttgaatcgtatgaacaataaaagatgtgctgagcacatcttttattatatggaggactaatggaaaaacttaaaattggaaaaatagtaggaacacatggcttaaagggagaactaaaaattagatcaaatagtgattttgctgataaaagatttaaaaaaggaaacgaaattattatacgttatcaaaatcaagatttggtctataaaattattacatcgcggatacacaaaggaaattatttagtatcatttagggataatcaagatattaatttggttgaaaaatatattggttcttttgtttatgggtataaagatgatgaactcttagatgctgatgaatatttttatacagacttaattggaatgcaggttgtttctacagagggaacaaaaattggtccagttacttcaatttatgataatactcgtcatgatattttaaatattgatcataatggtaaaaatgttgcaataccgtatgttgatgcatttattaaagatgttgatgtagaaaagaaaattattgtagttatgctaataaaggggcttattgatgaagattgatattttaacattgtttccagaaatgtttacaggttttttaaatacgtcgatcatcaaaagagcgattgacaaaggtttagttactattgaattacatgattttagagagttttctattgataaacataagcatgtcgatgattatccttatggcggaggacaagggatggttttaatgtgtgcaccaattgttgaatgtctcaaaacaattgcaactgatgatagttttattatcttaatgtcacctcaaggcattactttgaatcatggttgtgctgtagaattgtcagctaaaaaacatttaattatcatttgtggtcattatgaaggttttgatgaacgaatccgtgattatgttgatatggaattatcgattggtgattatgttttaactggtggtgaactaggaagtatggttgttagtgatgcagtgatacgcttattagatggagcaatcaaagaagacagtcatatggatgattcttttagccatggactgcttgagtatcctcagtatactcgcccacaatgctatgatggtaatgaagtacctgaggtactaatgagtgggcatcatgaaaatattcgcaaatggcgcaagttccaatcattaaaaaagacctatttgaaacgaccggacttattggaatcgtatcaatttgatgctgaaagtatcgaaatgatgaaaaaaataaaagaaaatgattgatttttatgattgattagtctataatgtaacagtcgcaagactgcagatgttccgctggttaatcgaatgaacgtttaagacaaaattttgataaggagaaatagtaatgaatttacaattagtagaacaaatcactaaaaaacaaatgagaaatgatattcctgagttcaaagcaggggatacattaaaagttttcgtaaaaattaaagaaggtgaaaaattccgtattcagttatttgaaggagtttgtatcgccagaaaaggtagtggaatttctgaatcttttacagtaagaaaaatctcttaccaagttggagttgaaagaactttccctgtccacactccaattattgatcatattgaagttgttaaagttggtaaagtacgtcgtgctaaacttggatacttacgtggattatctggtaaagctgctagaattaaagaaattagaaaatagaaatggctcgccatttcttttttttctaattttttgtataatagacataatgtaggaggacttttttatgtcaaagaaaaaagaagttatcaagttttcactacaactattggcaatcgttgcagttacaactgtaacctttactaaaataattattccggtgagggttgatggtcaaagtatgtatccaactcttcatgatgaagatattgcaatagtaaatgcgttatcacttgagcgaagtgatataaaacgttttgatatagttgtattgaaatgtgaaaaattggataaggatattgttaaacgggtaattgggttacctggtgatactcttgtttatagagatgataaactatatattaatggaacatactatgatgaaaagtacttgaataaagattatatcgcaaaagctaaaataaaatatcaaacggaactatttactaatgattttgaaatcacattaaatgacgatgagatctttgtattaggtgataatcggttacaatctgctgattctagaactttaggtacatttaaatatagtgacattataggcaaaaaaggtttagttattttcccgttaaaaaatatgaatttaattaagtaggaggtttaaaatggtaaaacagattcaatggtttcctggacatatggctaaagctcgtcgggaaattagtgaaaaaatgaaattgattgatatagtgatagagcttgttgatgctagggctccactatcttcaaaaaatccaatgtttaacgaaatttgtaataataagccaaggttgatcgtaatgacgaaaaaagatttagcggattctaaggcaacaagtaagtggattgagtattttaagggaaaaggtatttatgcaatttgtgtgaatttaaagaattttaatgaatatcagttggtcattgatgtatgcaaagaaatattgaaagaaaaaatggaacgtgaagctaagcggggattaaaaccacgggcaatgcgagcaatggttttaggaattcctaatgttgggaagtcaacttttataaatcgtttagcaaaaagaaaagcgacagtaactgggaatcgacctggggttactaaagctcaacagattataagagtagacaaagattttgaattattcgatacgccgggagtgttatggccgaaatttgatgatttgaatgttgctcgaaacattgctttgatcgggtcaatcaagcaagatatcttaccacttgatgaattgtttatttatgctgttaattatttagaaacccattatgcaaacattgtttgtaatcgctacaatattataatcgacttaaataccgattgggtagaaaaagcatatgatgatattgcaaaaaatcgtaaaatcaaaccagtgcgtggctatactgactatgatcgggttatggaagtgttttttaatgatatttttgatggtaatatggggaaaataacttgggagttgccaaatggaacgctatgagtatgaagaaaagtattatcaagctggatatgactatatcattggtttagatgaagctggtcgtggtccgatggctggagaattggttgttgctggagtggtttttcctaaagggttttatgatgaaagaattaatgattcaaagcagttaagtgctaaaaaacgagaagtattgtacgatttgattattgaaaatgcattatattatgatattgaaattattagtgttgcagatgtcgatcgtttgaatgtgtaccaagcaagtaaacaggggatggaaaaatgtttagaactactaaaaaaagagaagatgtttgcattaacagatgcaatgccgattgattatcctgaccatctttcaatcattaaaggtgatgctaaaagtatctcgattgctggtgccagtatattggctaaagtgacgcgtgatcgtttgatggaagcttatgctttggagtatcctgaatatggttttgaaaagcataaaggatatgttacgaaagcacataaagaagctctgggaaaatatggagtttgtccaattcatcgtaaatcttttggaccggtccaaaagatattatcaaaacagatgtcatttgatttttaatgacatttttttgatttttaaaagtaattttaagtttaatgaagtatataataatgaggtgataaaaatatggaagaaatcttattatatttttcattaaaatatgcaggtgattttgattcgattttaaaagctttagagtgtaaagaaaagatagatgaaaaattgaaaaaagaattgtttaaagatattacagccaattacactactttgatctcgccagattatccaactgctttgaaagagattgcctgtccgccattcgttttattttattatggtaacttagctttggttaaaaataaatgtattagtgtaattgggaagcgacatcctagtacatatggcgtagaatgcacagcagcactagcagcacagttggttgaagcaggttacacaattataagcggtatggcaatgggaatcgatacgattgcacatcaaagtacaattacagctaatggtcaaacaatagctgttttaggaagtggtattgattattgctatccacacagaaatcaacagctgtatcaggttttaaaagatcatcatttagttatcagtgagtatccgggaaaatttataccacaaaaaataaattttccaagaagaaatcgcataatttcaggattgagtgaatctatattagtaactgaagcaaatcagcaaagtggtacgatgatcacagtcgggcacggtctagaacagggaaaagatatatattgtgttcctagccgtatcaacgatgctttgggttgcaattatttaattcaacagggtgctaaattagttataaatgtgagcgacattcttaatggataaaaacagttttaaaaaatttagttgacaaaactttaaaaaacactaataattgtgttaatcgcgtggaggaaatgaaatgagcaaaaaattagttattgtcgagtcgccatcaaaatccaaaacaattgaaaaatatttagggagtgattatgtagtcacttcgtcaaaaggacatgttcgggatttggcaacttcaggaaaagaagggttaggtgtcgatattgaaaatcaattcgaacctaaatatgttataaataaagacaaaaaagatgttgttaaggaattaaaacaacttataaaagaatcagatgatgtttatctagcaactgaccctgaccgcgaaggggaagcaatttcatggcatttagctcaagtattaaatgtcgatatggataaagaaaatcgtgttgttttcaatgaggttacaaaggatgcagtagttgatgcactaagtcatcctcgtaaaattgaccaaaatttagttaagtctcaagaaacaagaagggttttagatcggattattggattcaaactttcaaaactgctacaaaaaaagatcaaatctaaaagtgcaggtcgtgttcagtctgttgcgttaagattgattgttgaaagagaacgtgagattgaagcttttgttcccgaagaatattggaaaataaaagcagaatttgagaaagacaaaattgaatttagtggtgaactagctaaatataataataagaagattgagataaaaaatggtgaagaagctactgcaatttatgaagctttaaataaagaatttgaaatcgctagtgtcaaaaaaacgactaaacggcgtgaatcaaaaccaccttttattacttcgactttacaacaagaagcatcttctaaattaggttttaaagcgagaagaacaatgtcaattgctcaaaagctttatgaagggattactttagaaaatgagacagtcggattaattacttatatgcgtactgactcaactcgtttatcagatacctttgtcagtgcagctcaagattatattggtgaaaaatatggtaaagagtatattggaaaagtaaaagtaggaaagaaaaaagaaaatgttcaagacgctcacgaagggattcgccctacgagtgcattaagaacgccggaaagtgtaaaagaatatttaaagccagaagagttaaaattgtattcattaatttacgctcgagcaatggcttcattgatggctccagcaaaatttgatgcaacttcagtatcattgatgaataatggttatgagtttaagactagtggttcagtaatcaaatttgatgggtacctaagagtttacggcgattatgaaaaacaaagtaatgaaattttgccggagcttaaagaaaaagaaatgttattaagtaaaaacattgaaaaaactcaacattttactaaaccaccagctcgttatagtgaagcaaaattaattaaagagatggaggaactgggaattggtcgtcctagtacttatgcaatgattattgatacaattcaaactcgtcaatatgttgaattggttgataaagctttcaaaccgacagaatctggaatcttgacaagtgatcgattaacagaatattttaatgatattatcaatgttgaatatacagcgaaaatggaacatgagcttgatgatattgctgaagggcaagatgaatatgctcacgctttacaaaagttcttagatttatttcaaccgttgcttgataatgcatatgataaaatggaagtgattgcaccgaagaaaactggagaaaaatgtcctgaatgtggacatgatctagttgaacgtaaaggacgttatggaacttttgttgcctgcgaaaattatccagaatgcaaatatgtaaaaaaagaccctgtagagattgaatatacgggtgaagaatgtcctaagtgtggaagtaagatgatttttaaaaatggtcgttttggacgttttgaagcatgttcaaattatcctgagtgtaagtatattaaaaacagcaagaaaaaagaacctgttacgacggatgaagagtgtccaaactgcggttctccgattgtaatcaaacaaggacgttggggtgagttcaaagcttgttcaaattacccgaaatgtaagacaatcataaagtagaacgaaagttctacttttgttttcaaaatagaaatgataaaattagaaaaggtgataaaatggaaaaaattgtaaatgtaattggagcaggtctggctggtgtggaagcctgtcatcaattagtaaaaagaggatataaagttcgactgtatgaaatgcgtcctaaaaagatgaccccagctcatcatagcggtaattttgcagaactggtttgctctaattcacttcgtgctgatgggactggaaatgcggtcggtgttttaaaggcagagatggaaatgatggatagtctcattattaaatatgctagaaaacatcaagtcccagcgggaggatcacttgcagttgaccgtaataatttttctcaagcgataacggagtacattcagagtcatcccttgattgaagtaattcatgaagaggcaaaagaatttcctgcaggttacacaattatcgcatctggtcctttgacaagtgatgctcttgcaacagcaattaaagaaaagttaggggaagattatttttatttttttgatgcagcagcaccaatcattgcaaaagaaagcattgattttgcaattgcgtattataaatctcgctacgataaaggggataatgaatatattaattgtcctatgaatgaagcacaattcaatgctttttatgatgccctagtcaatgcggaagttgttaaacctaaagattttgaagaaaaattttttgaaggctgtatgccttttgaagaaatggctcgccgtggaaaacaaacgttgttatttggaccgatgaaaccagttggacttactgcgccggatgggacgcgcccttatgctgttgtgcagttaagacaagacaatgtccaagcaagtttatataacattgttggttttcaaacacatctaacttggcctgaacaaaaaagaattattcaaatgattccaggacttgaaaatgcaagttttgttcgatatggagtaatgcatcgaaatagttttatttgttcaccaaaacatctattaaagacataccagttaaaaaattattctaatatatttatggcaggtcaaattactggagtagaaggatatgtagaatctgctcaaagtggtatggctgccggaataaacatggtccggttattagaagataaagagcctttgatttttccggagaatactgttatgggagcgttggctaattatataactaatgcctcgaaagaagattttcaaccaatgaaagctaattttggaattttgccagattttccaatacgaatcaagaaaaaagaacgtaaagctgcttatgcatcaagagcgttggaaacaatgaagggatttgttgatgaaaacaaccttggataaatatttccgacaatatcttgattatttacaatatcagcgtcactatgctgataaaacaatagaatcgtataagcgtcagatcgatcatttcaaacaatttcttattgaagaatctattgatgattataatgatgtgagttatgcaatgctacgtggatatcttactaagctatatgaaaaaaatctttctaaaacaacaattaatcataaactcagtgcgttaagaagtttttttaactatttattaaaagaagagttaataaatgataatccttttttgctgattgaatcccaaaaagttgcaaagcgtaatccggattttctttttcctgaagaaatcctaggactattagatagtattgaaacaaaagatgatctgggaattcgtaataaagcgatgatggaattaatgtatgcatcaggcttgcggtgttcagaggttgtaaatttacaactttcaaatatagattttaatcaaatggtattatttattcatggaaaagggaataaagatcgttatgttccatttcatgattatgctggagaatggttgattaaatacatacaagaagctcgtgaaaatttaatgataaaaaatgaggggcataatttcgtctttgttaataaattcggtaatcctctaactaaccgaggagtagaaaacatagtagatcgaataatgcgactttatgattcaaccaaaaaaattcatcctcatacaattcgacattcctttgctacacatttattaaatgcaggagcagatattagaactgttcaggagttgttaggtcatgaaaacttatcaaccactcaaatttatacacatatttcaagagatcatttaaaagaggtatatttaaaagcacatccacgaaatattgaataattcaagttaaaatgatgaaaaatatgcttgtatgattgaaaaatctatgataaaatgtttcaggtatgaaaaatacacacattatgaattcatttatctagtgccgtaaggtgataaatgttcgaaataatggaggaaaaaaacaaaaggaggaagttacaatgtcagtaatttcaatgaaaaaattattagaagtaggtgttcattttggacatcaaacaaaaagatggaatccaaaaatggctccatacattttcacatcaagaaacgggatttatattattgatttgcaaaaatcatctaaaaaaatcgatgatgcttataaagcaatgaatgaaatcgctgctaaaggtggaaaagtattatttgttggtactaaaaaacaagctcaagaagctgttaaagaagaagctattcgttcagaaagtttctatgttaactctcgttggttaggaggaactttaacaaacttcaaaacaattcaaaaaagaattagaagattaattgaattagaaaaaatggaagctgatggtacttttgatttattgcctaaaaaagaagtaatcttacttaaaaaagaagctgctaagttagaaaagaacttaggtggtatcaaagaaatgagaagattaccaaatgctttattcgtagtagatcctaaagctgaacataatgctgtagcagaagctaaaatcttaggtatccctgtattcggtatcgttgatactaactgtgatcctgatgaagttgattatgtaatcccagctaatgatgatgcaattagagcagtaaaattaattgttgctgcaatggctgatgcaatttgtgaagctaaaaatgaaccattaactgtagcatatgttaaagatgaagatgataaagaagtatctatgaacgatgcaatcacttcagttgaaaataatcaaagaagagcacctagaaataaaggtggaagacctaatcctagaagaaataatgctcctagaccaaataaagataacacagctggaactgaaggaaaataattctgtaaaataagggaaagcaaagcttttccctttttaataaaaaaaacaaataaaggagaaaattaaaatggcaattactgcaagtttagtaaaagaattacgtgaaaaaactggtgctggaatgatggattgtaaaaaagctttggaagcttgtgatggtgacatcgaaaaatcatttgactggttaagagaaaaaggaatcgcaaaagctgctaaaaaagctgatcgtatcgctgctgaaggtttaactgctttcgtattagatggggatactgctgcaattgttgaagttaactcagaaactgacttcgttgctaagaacgctgaattccaagggttagttaaaaatatcgctgaagttgttgctgctaataaacctgttgatttagaagctgcattaaacactgaagtagatggtaaaaaattagaaactgttatcgctgaagctagcggtaaaattggagaaaaattaagtttcagaagattcgaagttttaactaaaactgctgacgaagtatttggtgcttattctcatatgggtggaaaaatgactgcaattgttaaagttgctaattctactgaagataaggctcgtgacgtggctatgcatgttgctgcttctgatcctaaatatattgatagaactgcaattcctgctgaagttttagatcatgaattatctgtattaaaagctcaagcaatggaagaaaacgcagcagctgctaaacctaaaccagaaaatattattgaaaaaatggttgaaggtagattaaataaaaacttaaaagaaatgtgcttagttgatcaagaattcattaaaaatccggatgaaactgtagctaaattcttaggtgaaggtaaagtaatcaatatggttagattccaagttggtgaaggtatcgaaaagaaagaagaaaactttgctgaagaagttgctgctcaaatgaacgcaaaataataacttttaaaacactatcattagatagtgttttttctttggataagcgtcattcgactaggaatgtaccttgactaaacgacgaaaatatgataaattttttagaggaaaaagtaatcattattagctgataatgatgtgcgaatttaagcataaatctttttttataaaatataaataaggagattaatatgaagtataatcgggtattattgaaattaagtggtgaagcattggctggagatgataaaactggtatcaacgctcatacagtagcagatatcgctcgtcaaattaaagatgccaaagatttaggagttgagattgcaattgtttgtggcggcgggaacctatggcgtggtaaaactggtgctgatatgggaatggatcgttcaagtgctgactatatgggaatgctggctactgtaatgaatggtttagctgttcaaaatgcattggaggccattggcgttccaactcgtgttctttcagcgattgaaatgcgtcaagttgctgaaccatatattagaagacgagcaattcgtcacttagaaaaggggcgagtagtaatatttggagctggaacaggaagtcctttttttacaacagatacaacagctgctttgagagctgcagaaattaacgcagatgttatcctaatggctaaaaacggggtagacggagtttattcagctgatccaaaagttgatcctaatgcaattcgcttcgatactatttcgtattttgatgtattacaaaaagatttaaaaatcatggatcaaacagctatcactttatgtaaagacaataatattgatttatgtgtatttaatatgtctgtagacggaaacattgctaaagcatgtaatggcgatgatatcggaacaacaatctcaggaggaaaataaaatgataaatatgattttagatgatacaaatgaaagaatgacaaagacgattgaatctttccaacgtgatttatcatctgttagaactggtcgtgcaaatcctaatatgcttgatcgagtaatggttaactattatggttcaccaactccagtgaatcaaattgctggtatttcggtagtagaaggccgtcaattagttattaaaccttatgacaaatcaagtattaaagatattgaacatggcatttatgaagcggatttaggtcttactccacaaaacgatggtgagattattcgtattatggttcccgctttaactgaagaacgtcgtaaagagtttgctaaaaatgtttggaaatttgcggagaatgctaaggtgtcaattcgcaatattcgccgtgacagtaatgatgaaattaagaaaacagatggtagtgaagacgaaatcaaagctggtcaagaaagagttcaaaaattaacagataaatttgttaaagaaattgatgaaattgcaaaagtaaaagaaaaagatatcatgactgtataattagatgggcgttttaaacgcccattttatctaatttatttagaaagaagaaaatatatgcataaaagaccatgttcggattgaaatttagatagcgaaatatttcgtagctactattatttaaaagaagagcctgtggcattttgtcgagttaatggattacctatgagtggtggtaaagtggaaattacagagagaattggttattttttagatactggtaatatttcggatttgataagttcgaataaaagtaaatgtcaaataggaattataacagaagatagtaaaattgaagaaaattttgtttgttcacaaaaacatcgtgttttctttaaagaaaaaatagacaaaactttttcttttaacgtcccatttcaaaaatggttgaagacgaacactggtaaaatatatctgatgcaattaaagcatattatgagattttagaagcaaaaaagtcaacaaaaactgtaattgataaaaaatttgaatataatacatatattctgatttctttaaaaataacaaaggaaagacattagaacaggcaatcagatgctggaattataaaaagctgtaaagaccataatcgttatgaaggtgtatattttcttattttaatgtagtaaattaaataaataatttatatgtactaggatgattaagtctagcaatgttgcttaggctttttttgtaatgaatttatggtataatctcgaatagttaaacaggaggacgacaaatgttttttaagaaaaagaagaatgaagaatttaattatcatgttcttgataaagataatattcctcaacatatagcttttattatggatggaaatggtcgttgggcaaaaaaaggaagatgccacgcacttatggacatcatgaggggactaaaacaattcgagatgttgctttgcattgtaataagttaggagtcaaagctatgactgtatatgctttttcaaccgaaaattttgcacgaccagagcaagaggtacagtatatttttaaattaccaaaagatttctttgaattgtatatgaaagaactgatagaaaataatgtaaaaatctgtacaatcggacatttagaaatggctcctaaagaaactcaagatattattaactctgcaattgataagactaaaaataatactggtctaaaattatgctttgcttttatttatggtggacgtgatgaaattttagaagcaacaaaaaaactagcaatgaaagtaaaagctggtgaattaggtgtaaatgaaattaatgaaactgtctttaatgatgagttgatgactaaggatctaccggaagttgatttaatgattagaactagcggggaacaacgtttgtcgaatttcctgttatggcaattagcatatgcagaatttatttttacagatgttttatggcccgattttaatgaaaatgaacttgataaagcgatttggatgtaccaaaatcgtgatcgtcgttttggaggattaaaataatgaaagaaagaattattacggcaatctgtttgatgctggttgctgttccttgtgttatatttgggggatattattttaaaggcttgattggagtgattctagcattggcagtgtatgagatgttacatatatgcactcgtccaaaaataaaaatgtatttatatccaatcgtctgtggattttttatctatggttttttatttgaccaggatgatttatttttagcttcttatggaatcttaatctatttgattgtcttatttggagcaacaatttttgatgacaccttgacaattgaacgcactagttatatttttacgatgggggtactaatatgtgctggtttacacgctttaatgtcacttcgtgatgtatatggttttcaatatattttattgcttgcgttagctacttacggtagtgatacaggcgcatattttgcaggagttttttttggtaaacacaagttgattcctcgattatctccaaagaaaacaatagaaggatcaatcggtggggtgctgcttgggactttactatcagttgggtatgctagttatttaggtttgttagaaaataatgtgattttaattgcagcatttttcgttttaactttcactagtcaaattggtgatctagtttttagtgctgtgaaacgtcattttggagtaaaagattactctaatttattacctggacatggtggcatattagatcgtattgatagtattttatttaatgcaatagtttttagtttctttttagtaatggtgaggttataaaatgaaaaaaattacagtattaggagttactggatcaattggaatgcagacagttgatgttgtaatgaatcatcctgaacagtttaagattacagcaatggcagcagggtataatgtggctaaggttgaggaaattttagcaatgattgatgttgagtatatctgtatggtaaaaaaagaagatgctttatatcttcaagaaaaatatcctgatcttaaagttgtttatggtgaaagtggattgatagaaattgcaactttaccagagattgagattgtattaaatgcaattgtcggatttgctggtttagtcccaacaattgaagcaattaaagcaaaaaaagatatagctttggcgaataaggaaactttagtcgtagcggggcatataattactgaactggtaaaagaatatggcgtcaaacttctaccggttgatagtgaacactctgctatttttcaatcattaaatggcgaagaacacaataaaattaagaagattattttaactgctagtggtggcagctttcgtgataagcaacgtgatgaattagcaggtgtaactgttaaagaagcattaaaccacccgaattggtcaatgggagctaaaattacaattgattctgcaactttatttaacaaagggttggaagtaatggaagcaaaatggttatttgacgtggattatgatcaaattgaagttttaattcatcctgaaagcatcattcattcgatggttgaatttgtggatacttcaattatcggacaattaggcaatccagatatgcggttaccaattcaatatgctttaacttatccagaacgtgattatttaattggtggtgaaagtcttgatttagcaaagattgcatcattaacatttaaaaagccagattttgaacgttttagagcattagctttagcttatcaagccggcaaaagtggtggaagtatgccgtgtgtgttaaatggtgcaaatgaacaagcaaatgagctatttagaaatggtaaaattgagtttcttgaaattgaaaatttagttgagaaagcattgaataaacatcagttagtcaaaaatccaacacttgaacagttgattgaaatcgatgcttgggctcgaaactttgttttaaaagagataggagaagattaatgcagacattaattaatattgtcgtttttattttgattcttggaatcgttgtgctgatccatgagttaggacattttattacggctaaatcgtttggggtttattgtagtgaattttcaattgggatgggaccaaagatattttcgcgcaaaaaaggtgagacagaatatgaaatcagagctttaccaattggtggttttgtatcaatggctggagaggctgataatgatattgaggaatttaaagatgttccaattgagcgtactttaaagggcattagctgctggaaaaagtgtgttgtttttttagccggagtctttatgaattttgttctatcattagtaattttaattggtgtttattgtgtaatagatgttcaaactaatacacctgaaatcgggaaagttacttcggacagtcccgcaatgattgcaggccttgaggcgggagatactatttctaaaattacttatgatggtcatgaaaatattattgcatcttttgcagacattcgtgaagtgttgaataatgataatcttaaatcaaaaagtgctacaataatgttgcaagttgaattggtccgtgatggtaaaacaattactaaagaagttaatgcaaaatataatagtgattctaattcatacacaatgggtttgactccagcaacaagaaatttaagcttttttgaagctattaattatggggtaactaaatttgtagagatggcgctgttgatttttacaacattaggtaagctatttacagactccgctaatacaattggacaattgtcaggaccagcgggaatttacaacgtaacggctcaaattactgaaacaggatcaattagtcaattattaacattgctagctttattatcgactaatattggaatgttcaatttattgcctattcctggtttagacggttgtcaagttatctttgctgtggttgaaagagtaatcgggcgtgaattaccgttaaaggttaaatatggtttacaaattgctggattagcccttgtttttggtctaatgatctttgtaacctttaatgatatttctagaatatttggataaagggaattaattttcccttttttatgctataatgtttgagtgttatattgataagaataatgaaggatgatttgatggaaaataaattattaatattattaaaaaatttaaagattgaaagccaagctaatattttaaaagaaggaaaaatcagtaaagttgttgtagcgagagataatagttatacttttcacttagtgtttaatcagattttgccatttgaggagtatcaattattaataaataaccgcgataattttccttatcctactaaatataaaattagttatgaaactgaattttttaatcaaaatgaattattattatataccggataccttttagaaaaattaaaaaaagattatcctgtttgtgctactttaacagttgaaagttttaaaatcgaagataaagttattagagtagaaacatgtaatgaaattcagttagaacaattacgtcagttaagagcacaaattgaagatatgttcaatgatgtaggtatcgataaaaattttgatttttatattgatgaagaaaacgatgtatttaaagatattaaagaagagatggaagcttatgaaccagttgaaattgacctttctttaatccaaaagccagataaaccggcgtcagaacaaaataattataagaataattatcgtcaaaaaaatgcagcaatcgatatgaaaattgaagagattactaatcagacaatggataataatattgtaataaaaggctttgtttttaaaacagaaatgattaaaacaagagcgggaaaacatattcaaagtttatgggttacagattatactgattcaattattgttaaacgttttgaaaacaattctaataactcgttagaagaattaaaagttatcggtaaaggcggagtttgggtaaaagttcgaggtgaagcccgttttgatagctttgcacgcgaaacagttatgatggctcgcgaggttgaagtgattaagagcccagcaccacgtaaagatactagtgaagcaaaaagagtggaattacatacacattcaaaaatgtcagcgatggatggggttggaacaattacccaatatattaacgctgtagcaagctggggacataaagcaattgctgtaactgatcatggtaatgtccaatcttttcctgaagctcaaatggcagctggaaaagcaggaattaaaatgatctatggtgttgaattcaatatgatcgaaccgattttgaatattgtttataacgaaatagatacctcaattgaacatgcaacctatgtttcttttgacttggaaacaacaggtctatcagttattcacgatgggattacagaatttggagctgtcaaaattaaaaatggagaagtaattgatcgactgcaaatgtttgtgaatccagggaagagcatttcctcaagaatcactaatttaactagcattactaatgatatggtacgtaatgaaccgacgattgatgcattattgcctagaattatagaattttttgatgattgtattttagtcgctcataatgctaattttgatattggatttttaaatgagaatttacggcgaaataatatgcctgaaattacgaacccaattatcgattcattggctttagcacgagcaattttgaaaccgatgaaatcgtatcgattggggaatgtgtgccgcagttatcgagtaaattatgatgatgaagtggctcaccgtgctgattatgatgctgaagtattaggtgatgtttttaacatgatgttacatcaaattatgcaaagcggtaaatataatcttttagacttgtgtgaattaacaggggatgatgtttataaaattgtttatccttatcatatgaccgcattggcgttaaataaagctggtttaaaaaatatgtttaaattggttagtgaagcaaatactaaatattttcataatggatcaagaattcctaaagaacgtttagaacattatcgagaaggcttattatatggcagcagttgctataacggtgatgtttttgaggcggctctgaacttatctgatgaaaaattagaacgggccatggaattttatgactatattgaaattcaaccacttgaggactactatcacttagttgatcgtggaaaattgcaagatactgatgagttaatcaaatctttacatcggattattgattgtgcaaaaaaactagataaattaattgtagcaactggtgatgttcactttttagaagttcgtgataaaatttttagagatgtttttatctctaatccgacgattggaattggtcaccgtgctcatccgctgtgtgatcgacgcaatcctaaggctaaaaatccctgccaatatttgagaacaactaatgaaatgttagaaggttatccttatttaccacaagacgaagtatttgaatatgttgttacaaatacaaataaaattgctgatatggttgaggaaatcaaaccagtgcatgataaattgttcacgcctaagatagatggtgcagacgaaaatctaaagaagatttgttacgatactgcgcataagacatatggtaatccgttaccgcaaattgttgaaaagcgccttgaaaaagaacttagtaatatcatcaagcatggctttggggtcatttactatatttctcatctattagtaaaaaaatcaaatgatgatggctatctagtaggttctcggggatctgttggttcttcatttgttgcaacaatgtcaggaataacagaggtaaatccgttaccgccccactatgtatgcctccattgttcgcatagcgaatttttagaagaaggaattgtggctgatggctatgatttggaagataaagtgtgccctaaatgcggtaaaataatgaagggtgaaggacataatattccatttgagaccttccttggatttaacgctgataaagtaccggacattgatttaaatttctcaggtgaatatcaagctaatgcacatgcttttactaaagaaatatttggtgaagatcatgtttttagagcaggaacgatttcgacagtagcagaaaaaacagcttatggatatgcaaaaggatatgctgaattaatggggactgatcaaacaattcgttctgctgaattagagcgaatcgcagccggctgtggtggtgttaaaagaacaacaggacagcatcctggtgggatcatcgttattccaggggatatggatgtatttgattttacaccgtatcaatttccggcagatgatctaaatgctgcgtggaaaacaactcacttcgatttccatgctattcatgataatgttttgaaatttgatattttaggccatgtcgatccgactgtaacacgatttttgcaagatctgacaggtgttgatcctaaggatattccaactaacgataaaaaagttatgagtttgtttactagcagtgaggcattaggatgtaatcttgattttattggttgcaaaaatggagctttagggcttcctgaatttggtacctcatttgtacgtggaatgttagatcaaacccaacctaaaacatttaatgatttagttattatctcggggctatcacatggaactgatgtatatttaggaaatgctgaaacgttaattaaatctgggacttgtacactttctgaagtaattggatgtcgtgatgatattatggtttatttgattgaaaaaggtttgccaaacaaggatgctttcgatatcatggaatgtgtccgtaaaggtaagtcaccggtagtttttccagaaaaaaaatatgaagaactaatgaaagaatacaatgtaccgcagtggtatattgattcttgtaaaaaaattaaatacatgttccctaaggctcatgctgctgcctatgtattatctgcaattcgagtagcttggtggaaattatattatccacgagaatattatgctgtttattttacaacgagatgtgatttttatgatattgaaacacttgtacaaggtaaagatgctatcatggcaagacgagctgaaataacgcagttaagagctgaacggagttcttcaaacaaagatgaaggattatgggatatttttgaaatcgcactagaaatgattgagcggggattccattttaatccagttagtttagagtattcacaagctagcaagtttatattagatccaaacgatgaaaaagggttgattccaccgtttagtgcaattgatgcattaggtgaatcagtagctaaaacagttgtagatgctcgagcagatggtccgtttttatctaaagaagatgttattaaacgaacaaagttgaacaattcacatattaaaacactatctaaaatgggggtttttaatggaatgcaggagcgtaatcaactttcacttttctaagtagttgcaataattaaaaaaatgtggtattatttatttagtttcatagagaagcgagtggggtgacccactctttattattgaatagaggtgaaagaatggaacttttagatacgattaaaacactgataaaaccaattttagaaaataatgatgtatatcttgatgatattgaataccttcaggaaaatggcgaatggtatcttcgcatttttgttgaaaaaaatgaaggttccctagacatggacacatgtgtagcagttagtgaagcaattagtttaaagatggatgaagaagatccgatcaaaggagaatattatttagaagtttcttcaccaggtgtagaaaagcccctaaagacttttgagcaagttaaagcttcagtaggtaagtatgtctacgctaaattcattaatccaactgctggaatggatgaagtggaaggatttattaaaacaattgaagatgaaacgattgaatttgaatatttagttaagaatattaagaaaagaattaaaattgactatagcaatattaaatttataagactagctgtgaaattttaggaggataaaaaagtggcaagtaaaaaattcatggatgcactaaatttattaattgaagaaaaagggattgaaaaagatgtctttttagaaatgcttaaagaatctattggtaaagcatataagaaaaattatttaaaccctgatgctaatgtccgtgttgaaattaatgaaaaaactggaaagtttagattatttgaacttcgaacagttgttgatgatctagatgatgaagatattgaattatctctagaagaagctcaagcaatcaatcctaattatcaaattggagatgttgttgaaactgaagccgatatcgaacatattggacgtttggcagctattcaaacaaaacaattatttagacaaaagattcgcgaaactgaaaaagaaacactttataacgaatttgcagataaaaaagatgatatcatcacaggtatcgttgatcgtgttgaggataaatttgcaattgtaaatattggtaaaacaggagctttcttagcttctaatcaacaaattcctggtgaaaaattaaatgagggtcaacatttaaaagtgtatgttagcgatgttgatcgtggaactaaaggaactcatattgttgttagccggacagagccgagttttgttaagagattatttgaattagaagtacctgaagtatacgatggaacagttgaaatcaaagcagtttcacgggaaccaggtgaaagaagtaaggttgctgtttatactagtaatgaaaatattgatccaattggctcttgtgttggaccaaagggaagtcgagttaaaaatgtagttgatgagttaaatggtgagatgattgatattattttatggagtagtgatccggttgtctttatttctaatgccttgagtccatctgatgttaagtgggtatctattaatgaagaaaatcacagtgctttagtagttgtaccagatgatcaattatctttagctatcggtaagcgtggtcaaaacgctcgtttagcagtacgtttaacaggttggaagattgatattaaatctgttagtgaggctgttgaacttggtttaattgatcttcaaacagttaataatacagaagaatcatcacctgttgatgctagttttgaagaagagtttgctcaagaaatgttagatgaagcagttgaggaagctgttgtggaagaagctgttgaagttgcagaagaaccagaaatcgaagaagaagttgttgaggttgaagaagaacctactcaatcgaaaaaggttattgaatacgaagattttgaagatttagatgatgaatatagtaaatatgatgaagaaatcgattacgatgaatatgatgaatactatgataaagattaaggagtgattaaattgcgaaaaatccctttaagaaaatgtttagcaacgggtgaacagttgccaaaacaacaattaatcagaatcgtacgtaataaagaaggtcaagtagctgtcgatccaactggtaagatgaatggacgaggagcttatctgaaacgtagtcatgaagcgttcgtgttagcaaaaaagaaaaaagttttagctcgggctttgcaggttgaaattcctgaagaaattttcgtagaactggaaaaatttgcggatgaataattatttaaatacacttggcttggctgcgcgagctcgaaaaatcattactggtgaaactttaatcacaaagattagaaataacgaagtagaatttgttattattgctagcgacgctagtgacaatactaaaaaaaagatcaccgataaatgtacaagttataaagttgagtatgttatagcttgtactattgatgaactatccagtgcaatcggtaaaaaaaatcgagtagcacttggtatccaggatactggatttgctaaaatattaaaagaaaagataggagggtgaacatatggcaaaacaaaataaacaaacaaaaaataaaaaaggtgcgccaagaaagaaacaattaaagtctaattttccgaccaaaaaagaagaaatagttgctaaagatggtgtcattgtttatgaagaaggtattactgttggtcaattagctgataaaattggacaaacgcctgccaatgttattaaagtattgtttctattaggaacgatggtaactattaattcatctttaaatgatgagcaagtagaattaatttgtcttgaatatggttttgaagtcgaaaaacatgttgaagttagtgaagtgaattttgaggaaattgatattcaggatgatgagaaggatttacagcctcgttgtccagtagttacaattatgggacatgttgatcatggtaaaactacattgttagatacaatcagaaagtctgcggttgtagaaggtgaatttggtgggattacacaacatatcggtgcttatcaagttgaagttaatggaaaaaaagttactttcttagatacaccgggccatgaagcatttactgctatgcgtgctcgtggagctcaagtaactgatattgttattattgtagtagcagctgatgatggtgttatgccacaaacaaaagaggcaattgatcatgcaaaagcagcaggtgtaccaattgtcgttgcgattaataaaattgataaagaaggtgccgatcctgaaagaatcaaaggagaaatggctgagcatggtctgcttcctgaaggttggggtggagatacagtatactgtgaaatttctgctaaaaaaagaattggaattgaagaattgctagaaactttaactgttgttgcagaattagcagatttaaaagcaaatcctaatcgttatgcatatggcagtgtagttgaaggtaaactagataaggggcgtggaccagttgcaacgttacttgttgaaaatggtactttaagagcgggagatccaattgtagttggaacatcatttggacgtgttcgtcaaatgcttgatgatcgtggaaaaattattaaagaagcacttcccgctactccagttgaaattacgggtttaaatgacgttccagttgctggtgataagtttatggcttttgaaaacgaaaaacaagctcgtagtgttggtgaaacacgattaaaagcgaaacaagataaagagcgtagttcaggagctgccttatcattagatgatttatactctcaaatcaaagagggcgaaatgattgacttaaacattattgttaaagctgatgtccaaggtactgctgaagcagttaaagcttcattagaaaaaattgatgttgatggtgtaagagtaaatgttattcgttctacagctggaggaatttcagaatctgatgttctattagcatctgcttcacaagcaattatttatggttttaatgttcgtccaaatgcaaaagtacgtcaaaaggctgaagaagaaggaattgagattcgtttacacaatatcatctataaaatggttgaagagattgaaaccgcgatgaaaggtatgcttgctccagaaattaaagaggttgttacaggtcaagcagaaattcgtcaggtaattaaagtttctaaagttggaaatattgctggatgttatgtaacagatggttttattcgccgtaattgtggaatccgtttacttcgtgatagtgttgttgtatatgaaggaaaattaggttcattaaaacgtttccaggatgatgctaaagaagttgcagcgggatttgaatgtggtttaagtattgaaaacttcaatgatattaaagaaggcgatattgtcgaaggatatatcatggaagaagtcgaagttaagtaggtgaattaaatgattcttaaaaaggataagatgaatggtattattcaacgcgagttatcacaaatcattcaagttgaagtacgtgatcctaagataggtttttgtactattactgcagttgatacgactactgatctatcaattgctaaagtatatgtgactttcttaggaaaagactttgatacgcgcaaaggaatggaagcattaaatcgttctaaaggatttattcgttctttattagctaaacgtcttacaattcgtaaagtaccagaactgatttttgttaacgatacctctttagagtatggtaataaaatcgaaaaaattattgatgatttaaatcatcatgataaataattcaaaagaaggtcaaattgaagtgaagccaatttcttggacactaatttagttatgctattaataaggattgatcctgtattgcacaggagttgatccttttaattttgttgttatttttttgagtatagtattgttttatacattcttctattgcaatctttaaattatataacgatctaaaagtatattcataaccataaaaaatttcatttttccaacggaattcttcattggtgaattatctaaacaatttcttttttaatattgactgtggaatttattcttttcaaaaattttttatacacaatatttttttgttatcttgtgagtttaaccataataaaatgaactccaccatttgaaatacctaaataatgggactacaataaatcaccttctttttatttgagtcttatttgtttcatctagatagaattgtgctataatactatatagatataggaggactaaaagaaatgaaatactgtataacaaacgggaaagttattttaaaaaatcaagtagtagatgcaaatgtatatgtagaaaatacaaagattactgagatttctaatcgtcaacctgatgatgaaacagtaattgatgcaaaaggtagatatgtgtcaccaggatttattgatgttcatactcatgggcgtggtggcagtgatacaatgtataacacttttgaagatcttgatacaattacaagtactgccgtaaaaacaggtgtaacaggaattttacctacaacgatgacgatgtctaaagaagatacttatgcggctattaaaaatgttggagataacatggataaagttggaggaagtaaaatcctaggagtacacatggaaggtccattttttaatacaaaatataaaggagctcaacctgaagagtttatgatcaaacctacagctgaaaattatagcagtttagttggtgaatatggtaaaattgtaaaaaaattaagtttagcaccagaattaaaggattctgataagttaatcgagtatttagtcaaagaaggtgtggttgtaagtattgggcacactaatgcaacttatgacgaagcagttgttggaattaaagctggagcaacttcaggtactcatacttataatgcaatgacaccattaacacatcgaaatccaggagtagtaggagctatcatggaacatgatgaagtttatgcggaattgattttagatggaattcatgtcagctatccagctgcaaaagtgcttttaagggctaaaggtttagataaagtgattttaatcactgattctattgaagcttctggtttagaagatggtcaatataaattaggtaatcaggctgtatttgttaaagataattcagctcgtttagaagatgggactttagctggtagtattttagcaatgaataatgcagtaaagaatgcatatcaacatttaggtttatcaattaatgaagctgttaatttagctagttataatcctgctaaaaatttgaatttaattgatttaggggaaattgcagttaacaaaacagcggacattattatgtttgatgaagaaattaatgttgattttgtaatgattgatggaaatgtaaaaattggaggatagtatgattacattaaagaatgaagttttagaggttactctagctaataaaggtgcagaaattattaaaattgttgggcaggatgatcaaattaattatatgtggcgtcgtgatccaattcaatgggcgaatagtgctccaatcctatttcctattgtaggtgcgctacaaaataatgagtgtcgaattgatggtaaaacttatactatgactcaacatggtttttcacgtcatagtgaatatgaggctaatcaaattaatgatcaagaagtagtttttacacttatttcaaatgaggaaatagctaaacaatatccatatttatttaagttagatgtaacttataaattggataagaatgtacttagctgtaattgtaaagttactaataccgatagtcagactatttatttccaaattggtggtcatcctgcatttgcttgtccttttatggaaaatgaatcaagtaatgattactatttagaatttagtgagaatgagactgttaatcaaaaaattattgatgttgaacataaaggaatgtcagatataacattaccgtttttagataacgaaaagagattttttgttcgtcagcaattatttgataatgatgcaattgttttaaaggacgtgaaatcaaaaacattatcattgaagtcattaaatcacaataaatctttagtattccatatggaaggttttaatcacttaggtatttgggcagctaaacatgtgggtggactaattgccattgaaccttgggtaggtcatagtgattatgttggtttcactggggaatttaaggataaagagggtgtagttagtctaaatcctagtgagatttttgaatgtacttttaaagttgaaatcaaccaataatgacaaaaaaggaataagataaattttataattatcttatgaaagtaaaaattattgaaaaaacacacgagttagatttagaagatgaaattaatgattttttggaaaagaaaaatcctaaaattttatcgctgcattatcaagtggcaatgactttttcaagtgaattagaatatagttttagctgtttgattgagtacgaggataaataatcatatttatccttttcttttcgcatacttttagtattttagttaaaactatttatggaggtgattccatggctaaaggtgtatgttgtcacgttgatacttgtgtttacaatcatgattgtaattgtgaggcaaaagaaattacagtttgtaattgtaaatgtcacgaagcgaaagatattcaagaaacagcttgtgaaacttttaaatgtaaatagaaagtttaatatgacatcacaaaaggtaagaagtaacttttgtgatgtcttttgttataagtatgagctttacaaaaagacatttatatgttttattttttgtatacatataaaaacgtgatataataaaaaaggtgataaaaatgaaaaaaattgctttgattctaatttgttgcctagttttaatagggtgcaaaaataaagacaataacgataataaattttatcgacaatataaagaatatgaaaataaaatagataatcataatgaatttttgaatgctacaaatgaatttaatatacgtttagtagtcaataaagttgaagataaaaaatatcggtatgatgttattattgacacaccgacaataaatatgtatcatttacaagcaatagcaaaagttgctggtgatgataatgaaagtctaccaaccttaggaattcttgaggaagatattttttcattagttcctgaagtagtagataaagccaatggaatttataagggtgtaaatctatctggtattactagtaaaagtgaatttagtgtattggtttatttgactttttcaacagataaacaatctaataacaaagaagaaaggtatattaaactatatggtaatgcgacttgataaattgcttgcaaactatgggattggtactagaaaagaagtaaaatcactgattcgaaaaggttttgtaaaagtaaatggaatgattataaagaaagatgattttaaagttgatcatgaaattgatgaaatagtatttgatgatgagttgattgaataccggccatatgtctatataatgctgaataagccagcgggatatattagtgcaactaaagacaatcttcatcctacagtattagaactgattgagggctatgaaaattatgatttatttcctgtcggccgcttggatttagatacagaaggactattgttaattactaatgatggtgattttagtcataaattattagcccctagtcgaaatcattcaaaaatatattttgcaaatattgcgggagttatggatgaacaagatattcaggcatttaaagatgggattattttaaatactggctatcactgtaaacctgccaacctagaaattattaataaaaacaatgatagttgtgatgttagaattgaaatatttgaaggaaagtttcatcaagtaaaaaagatggttgaggtttgtggtaaagaggtaatatatttaaaacgcttatcgatccgcaatcttgaactggataggagtttatcattgggtgattttcgagaattatctaatgaggaattagtcgacttgatggaggatttatgatagaatatttttatatgtaaaggggagtaataatgcgtttaagaaataatccaaaagcatatgatattatgaaagaaaataaatcttttgtaatattggagccggaaaattgtaaaaataaatggaaagatatttttggaaataatcatccaatatatattgaaatcgggatgggtaaaggtgattttatttatgaaaatgctcgtcaatttccagaaataaattttgttggtattgaaaaatacccaagtgttttagcagcagcaataaataagataaatgctcgtgaagaaaaagtaaataatttgcgtttaatgcattacgatgcaattgaattgcatcaagtatttgaaaaagatgaagttgataaaatattcttgaattttagtgatccttggcctaaaagtaagcatgctaaaagacgacttacatcaagtaaatttttagatgtatacaaggatattttaatagatgaaggaaatattgaatttaaaagtgataatcgtggactgttcgaatattcgattatttctttaaaccaatatccaatggatatagagtacattagtttagatttgcataacagtcctgaaagtgaaatcaatattatgactgagtatgagcgaaaattttgtgagaaagggccaatttataaattggtagcaaggtatcgtaaaaatggataaattagtagaaattaaaacaatcgaagaatttgacaatattcgtgtaggtaaaacgattataatgtttacagcagactggtgtcctgactgtatgtttgtaaaaccgttcattggcgatattgttgatgccaatcctgaatacaagttttatatgattaatcgtgacaatatgattgatttgtgtaaggatctggatattttaggtattccttcttttgtagcttataacgataaagaagaaagtggacgctttgtaagtaagttacgtaagactaaagaagaaatacaggcgtttattgatacgttaaaataagaggtgtaggaatgatatttcatggattttataatttaaaacatgttggtgatattttattagcacgatgtggagaaggtaggacctttgattatgataaatatgatgatttagtcgtattgaaagatagtaaaaataggatacttggttttaatttgttgaatgctagtaattatttgggagaattaaatactggactagttaatttttcagataatcaaattgaaaaatttaatgaacttttaacaactcacggacttgatccggttgtcttagacaaagaacctcgttttattgttggtgaggtaactgcaatggaagaacatccagattctgaccacttacatatttgtcaggttgatttaaagaatactactacacaaattgtatgtggtgcccctaatgttgaagttgggcaaagagtggtagtagctactattggcgcagttatgcctagtggattggttattaaaccttcaaaactacgtaaaattgattctaacgggatgatttgttcagcaagagagttaggactgcctaatgctccccaaattagaggtatattagttttagataaagataaatatagtattggagattcatttttctagaaaagggggaaacagtgatgtttagaggcttatttaaaaagcatgaagaagatgaagatatttttgaagtggatcctgtcgttgaacagcgacgtaaggaaaaatttagcacgccattaatatatgatgaagaatttaaagaggagccagaagtgactgtaacgcctaccccaaagactaaagaaaaaactaaggttgttgaggcaaagcctaaggtagaagaaaaacctcgtcaaatttaccaaatgagtgaagttatttcaccaatgatgggaattacaaaaggaaaaaatgataaaaaagctgtaaagccaacaacttcttcaaaacctaaaaaacgtaaaaatgttgatcaattagttcctgtaattagtcctttttttggaaattatgaggaaaaggaacaagttgaatcagaagcaaaactgacaactattaatgatgaacctaaagaaaaaaaagttattgaagatttgcctacagtagaagataatttacgtaatatagctaaaattgtggaagaagaacaggatcagcttaaaattattgaggagcgaactggtgagttcaaattagattttggtactaacgatgttgaaaaacaaaactctttgattgatgaaattgatgatgatatgtcattggatgaattaatgagtttgtatgaaaagaagtttaaagactaacaatgataagtggtattggttgtgatattgttgatctaaatcggctgaatttagataatgaatgttttgttttaaaactattaacaaaaaatgaatttttaatttttaaaaataaaaattctttaaaacaaaaaaaagaatttttgggtggacgttttgctgccaaagaagctttttttaaggctcatgggattgaacatggcatgctgtcttttcatgatattgagatattaaatgataaaaacggcaagccaaaaattaattatcctaatacttttatttcaatcgctcatgaaaatgattatgcaattgcatatgttgttgtagaagaaggctaaattgccttctttttcagtatatattggtaaatttattagataattatagattagagcaataataagatatttgtaaaattagttttgaagattttataaaattattatatagttggtatatgattcttttatgagttacttgtaattgggcaataattatatacaagatacaataaaaatattgcaatattaaatgaggtatatttttattttcaacagttgttataatttcattttttggtataataacatacgtaaaatttcaagtttgtgataggaagcgaaaatcatgtatgaagataaagttaagaaaagtcttagaaaaataattatttttgcagtcattattgggatatttttagcatcaattggagctggatttttctatgtgataagaacagcttttgatcgttcaactgatgaaagaatgattgaagaaacagataattataaaaagagattagataaacaaattaataataattttcaaatgttaaatactgtcgcaagcattattggaaattctaatttggatgagtctgctgattttgattccattttggaaagggcatatattgaaaatgatttcttgacagttgcttttttttacaatgatgaaatgggaacactatctacaggtgatcatattatttctagtgatattcatttatcgtcactacagcctgaagtacaagaagttgttcgtaaagctttgcggggaaaggaaaatgtttcagaaccattctatggtgatttttccgaagaagaggtttttacttttggcgttccagtatatcgaaataaacaaattgttggagctatgattgctagtagtgttgttgatgtattttcagaaattatagatggcgaaaaggtcttaaatgggagtgcttatatccatttattggatgtgaatgggaaatttttgattcgttcctcacatgcagttgttaaagaaaaaaagactgatatatttaaagaaccgtatttgtctggagatgaattaacaaaaattaaaaaaagtatgaaaaattctgaaatagtccgttttacatttacctatgaaggaaaagagtatcattcaattttagaaccgcttgatgttaatgaatggtatttgttttgtattaactctgttcaaaatagtaatagtggaatttactcggttgcttatgcagtagcttgtttctttgtcattatagtgttactagtaggttatcttttaatttatggttatcggacaatgaaaaagaataaccagcaattaatggattttgcatatttagatcgtctaacaggaatttataatttaaatcgttttggggaattggcacaccagcatattgaagaacattctgaatatgcaattgctgcactaaatgtacgtaaatttaaatttataaatgagatttttggaaaagaacaagcagataggttactgtgctacattggaagaattttaaatgataatatcaaagatggtgaacttgtctgtcgtgatagtgctgatgttttttatatgtttttattagagactgaaaaaaacattcttgaagttcgtcttaaagaaattttagaaaaaatcagaacgtcatcgaatgattctaatagtaattatagaattactatgagttgtggtattgcaacagctacagacaagcaggaactacaagtgtcaatgacacatgcaatgtttgccttagaaatatcgaaaaataattttaaaataccgctgtggtttttcgatgcggctttacatgagcaagaaaaaatgaatgactatatcgaaaggcatatgtacgaagccatagaaaacggtgagtttaaattgtatttacagccaaaaatagatttaaaaactaattctcttgctagtgctgaagccttggtacgttggataagaaacgatgggactacaatttttccctcacaatttatcccaatttttgaacagaatggattttgtgttaatttagatatgtatatggttgaaaaggtttgccaattgcttcgccaatggattgacgaaggatatcaagctattccgattgcaattaatcaatcaaaattagtactttatgaaattggatacgtaaagaatctttgtggaatattagatagatataatattccagcatcattaattactttagaaattctggaagaaattgcaatcgaaaatgtagatgacttaaataaaaaattaacagaattaagagatattggttttaaaatatctatggatgactttggaacaggatattcttcattaaatactttaggaaaattaaatattgatgaattaaaactggatcgtagctttttagttgagataaaggatactagaaatcaaaatgcacgtttaataatggaggaaattgttcaactatctaagaaactttctatcttttctgttattgaaggagtagaaacaagtgaagatgatttattggttaaagaaattggttgtgattatggacagggatactattatagtcgtcctattgattcaaatgattttacaagcaagatgctaaataagtttaataaataattttaattgggagaattttaatggaaaatttattaatagataatatgctggaaaatgctaaaattggaatttgggttattgaattgtctcataataaaaagaatgaccctaaaatgtttggtaatactcatatgaaattactgttaggagtagcggattcttattcgccggaggaagtttatcaattttgggtagaacgaatacatccagcttatgtttcttatgtagaggaagcagttgaacgtttaataagtgggaataaggcagaagtcgaatatccttggaaacatcctgaaaatggctggatgtatatacgatgtggcgggtatctcaatactaattttacacaatgttatcgattggaagggtatcatcaagatattagtaatttaattttccgtttcgaaccattctcatttgattatcaaattcaagatcaacttttatttaaagaatattcacgctattatatggatatatacgatgaattatgtgaaattgatccggttacgaatacgatggagattgtttttcaacgaaaagataaatatttatccatattttcgggaattaatttttttgaatttataaaaaaatatatttattctatggatcatcttatcatttgtgaaacttataatgaattatcttcagcaaaaaaacaaaaagtgacgattgatgttcgtattcataatagtaatgatgggtattcatggatacggcttgtttttgtactagcacaaatgaactatagtcctaaagttttaatgggaattatggacattcaagaacaaaaacgaaatatggagttttttattgatagtgatgcaatactctcaacgattatcgaggaaaatgcttatatttttgatatagatataatgacacaaaacatatctgctattaaaggtgaaaatttatcaattcatgatatgtcttataacaaatttttatctttatttatgcagagatgcagtgatatttctgaattagaatatcttaatagttttttatcatttaaccatttaaaagaacttgtttttcaaaaaaagaatgcacatatcgatatccgtgaaaaaacagagcattttctttatggctggtatcggatccatttaatggttcctaaagcattagaagaccgtattttaattctaattaaaaaaatcgataaagacgatgtatttcaaacggtaattacaaaatatgtacaaaagaattttgaatcgctctgttatattgattgcgatagtggcaaatatttacaatttgttactgaaggaatgaaggaactaatttttaatgaaaatgaatttgattataaagatgccttagatacatttattgaaagtcaggtggttatagaagatcgcaaagtagctcaaactaaaatgaatctcgattatatttttttaactttgcaaaaagatggcgactatttttgtaatatacgaattttggatagttgtggagaatttcaccaaaaaacaatacactattatatttatgatgaagatacaaaaatcatattaatgatggttgcagataccacagaacaatatttattaaatcaaagtgaaaaagagcaaatagaaagattaaagctaaaagcaaatacagatgagttaactggactatataatcgatattattgtaaaacacatattaatgaatatttacaagaagtacctcaaggacagcaggcggtttttttattaattgatctagataattttaaaaatcttaacgattctttaggacatttagctggtgatcaagcattagttgatgtagcaaatgttttgaaaaattcattttgtgatgatgctattatttcacgttttggaggagatgaatttgtggtttttgtaaaaaacattcaagacatcaagctttttaatcgtttaatatccagacttcttcaacaattagatttgtattatcaaagtgaaaaggatcagataaacatccaagcttctattggaatagcactagcacctattgatggtagagatatgaatactttatatttaaaagcagataaagcgttgtatcaagcaaaagaaggcggaaaaaatagatacaagtattacaataattagttttgtttagataagatgttaactaaatatttagcccaatttaatattaattgaactctagcaaaataaattggaattctaaagataaagtatgtacaagcaagatgagttaaggtactataatggagcataatcaaaaatatatttatttctgtgtttaagaaagtataagaaaatatcttttttatattgtcctcattatgatggggtgggaataataaaaaatgaatcttaatttgggaatattaaactctatttttatagagttttttttgttattggaggtattgaaaaatattatataaaaataaatatagtagttattttgggcgaaacagggataagatggactttttttgcaaaatatgtatatttttttcgacaattttttatagactgatatagtctatttaagcatatctgttaacttttgctacacatctgaaagaaaaagtttcaccagtgacccattttgacaatgtcgttaattatggttaattttacagtgttgtaatctttttataattatgcctataattttgtcataaaggaggggtaaataatgttaaatactgtagcattagtagggagattagtagatatcccggaaatgaaaacaacgattggaggtgtaaaagtagcaaatgcaactattcaaatcgaacaaggttttaaaaatagtcttggtgcatttgaaaatgattacattgttgtaagtttatggcgcggtatcgctgaaatgattattgattgtgcaagaccaggatgcatgattgcagttaaaggaagactgcattcgagaacattagaatgtgccgagtcaaaacaaattacttcaattgaagtaattgcagaacgagtttctttattagataaatatttcaaaaactatgattaaatatcatttgagtttaaccggcttatttgttataatgatttaacgaaagtgggtgaaaaaatgactattgatcaaagtaaaattagaaatttttcaattatcgcacatatcgatcatggtaaaagcaccctagcagatcgaattttgcaaataactggagctgtcgcagatcgtgaaatgaaggcacagttactcgatagtatggatttagagcgagaaagaggaattaccatcaaattaaacgcagttcaactgaattatactgctaaagatggtcaaacatatttgttacatttaattgatacaccaggccatgtcgactttacttatgaggtatcgagatcgttggctgcttgtgaaggtgcaatattagttgttgattcagtgcagggagttgaagcacaaacgttggcaaatgtgtatttggctctagataataatttagaaatattgccagttattaataaaatcgatttgccaagtgctgatccgcaacgagttatacgtgaagttgaagaagttattggtttgccggcagatcatgcaccgttgatttcagcaaagagcggtttaaatgttgaagaagttcttgaaaaagttgtacaggaatttcctgctcctagtggagatgtgaataatccaacacaagctttgatttttgattcttattatgatagttatcgcggagtaattgtatttgttagggttaaagaaggaactattaacgttggagatcatgtgaagtttatggcaacaggagcaacatatgaagtaactgaattaggtgtaagaactcctcgtgaagtaaaaaaagaacagttagtggtaggtgaagtaggctggtttgccgcttcaataaaatccatccaggatattcatgtgggggatactgtaactacagttgaaaatgagtctaatattcaattacccggataccgccaattaaatccgatggtatattgtggtttatatcctgttgataacgctcgttataaagatttacgggaagcgttagaaaaaatgaaattaagtgattcatcattaatgtttgatccagaaacctcacaagcattaggatttggatttagatgtggttttttaggcttgttgcatatggatgttattcaagaacgtttagaaagagaatttgatcttgatttaattgcaacggcaccatcagttatttatcattgctatttgacagatcgtagtgaagtaatcgttgataatccagcgatgatgcctgagccgcaagtaattgatcatattgaagaaccttatgttaaagcttctattatgactccaaacgaatacgtaggggttatcatggaattatgtcaatctaaacgtggagaatatcaggatattgaatatattgatgatactcgacgtaatgtaatttatgaaattcctttatctgaaattgtatatgatttttttgacaaattaaaatcaggtactaaaggctatgcatctcttgattatgaattgattggctatcgtactagcaaacttcaaaaaatggatattttattgaacggagaagtcgttgatgcactttcaacaattgtgcataaggattttgcatatggacgaggaaaaattatctgtgaaaaattaaaagaaattattccaaaacaaatgtttgaagtgccaattcaagcagcactacaagggaaaataattgcccgtactacaattaaggcgatgcgtaaaaatgtattggcaaaatgttatggcggcgatatttctcgtaaaaagaaattactagagaaacaaaaagaaggtaaaaaacgaatgaaggcagttggaaatgttgaaattccacaagaggcattcatggcgatattatctgttgacgatgagtaggataaattatctatcctacttatttttttgttgtaaatagtcttgatagccattacaatataaatatatacgaataaaggagaatgaaaatgacaatcaaattaccagacaattttttctttggggcggctttatctggtccgcaaactgaaggtgcttataacgttggtggtcgcctaagatcatactgggacatgtggtctgaccaggaaatcaatgcttttcataacaatgttggctcatatgtcggaaatgatatgtatcaccgttatgaagaagacatcaaactgttcaaatcaatgaactttaaatcttttagaacatcaatgcagtggactagactgcttgatcaggatggaaatattaatccagaaggagctgcatggtatcataaactgatcgattgtgccaatgaaaacggaatcgatatctttatgaacatgtatcatttcgatatgcctgaatatttatataaacgtggtggttgggctaatcgtgaagttgttgaagcttatgcaaattttgttaaaaaggcaatggaggaatttggtggcaaagttaaatattggtttacattcaatgagccaatcgttgaaccagaacagcaatatttgcatggggtttggtttccctatgaaaagaacattaaacgttcattggatgtccaatataatatcacattagcacactgtctagcagtaatgaactttagagaactgcaggctgaagggaaaatggttgaaggagcgaagatagggatgattaactgctttgcaccaccatatacaaaagaagatccaagtccagaggatctggaagcagtaagaatgacagatgggttgcataaccgctggtggttagatgtagtagcacacggacatctgccaaaggatgtaattgatacagtagaaaatgaatggaagatcaaaatgaatcgtcgccctggagatgaagcaatcttagctggaggaaaagtagattggttgggatttaattattaccagccgacaagaattcaggcgccagatcagaaatttgatgaaaatggattgccatgtatagcgaaaccatatatctggccagagagaagaatgaacgaacaccgtggctgggagatttatccgaaaggaatctatgattttgggatgaagattaaaaatgaatgtccggatctgccttatttcatatcagaaaatggaatgggggtagaaggagaagaaaaatatatggatgagaatggatcggtacaggatgattatcgaatagaatttgtaagggatcatctggaatggattgcaaaagcaatagaagatggatcaaactgtttaggatatcattactggggagtaatagacaactggtcatgggcaaatgcttttaaaaatcgttacggattcattcgtgtagcattagatcagggatacaagagaattgaaaagaagagtgctaactggataagagaagtagcgaagaataatgaattcgagtaggaagtgagtaatcacttcctttattttttattaataatattttaatgtactatctaattattatagtttataattaataacgaatagggtgatatctctaattgttgtattaatattttttattattaggaaattagtaacatgttttgtctttaatcaatgatattttaatttttaaaacctattttgtcataaaatattttaataaaattatggcagttatttttactttgtggtaaattttgtttttaatttacttacaagtaaatttgttttataatgaacaaatgataaggaggcgtagaaatggcatttaattttcgaaataaaatacctaaggtacgtttttatggggcgtcagaacaagaacgtgaacaaaaaaatttacaagataacattgttagtcggcgattaatcggactactttgttttgttattgctgttacttccgtaatggcaatacgtttaggaattatacaatttaaacaggctgatgaattggcagtaaagctggaacaatatggtactactacatatacgagtgatgctcctagaggagaaattgttgaccgtgaatatgtaaaattagtggaaaatacaagtgtaatttgtgcaacatattatgcacctaaaaaaattgataatgatgttttaaaagaatcagctgcttttttagcaaaaaatatcaatattgatgtaaatgataaaaaaatcatttctgatcgagcaaaaaaggattattttattttagcttttaaagatgttgctgacggattgattagcgataaagaaaaagaagaaatcaaagctcaagaaaatgcagacaaaagattatatagtcttaaattagagagaattactgatgaattaattagtcaatatatggatgaagcaacattaaaatatactcactttttatacttgatgcaaaattgtacgagtggttcgtcaattttggctgaaggtttaactgatgaggaggctagtattattggtgaaaatgcagatatcttacccggggtgacagttacaacagattgggcacgtcaatattcaaattcaacagagtttgcttcagttttaggcaaagtgacgactaaaaaacaagggttacctgtagaattaaaaaatgaattattagcattgggataccaaaatgattctagagtaggaacttcgggcttagaggagcagtatgaagatattttacgagggaatgacagtacctataccttaaattatgatagctcaggaaacccaataataacaagtactaaagcaggaactgcaggttcaaatattcgtatttcaattgattgggaacttcaacaattggctaatcaaaaaatcgaagaggaattaaaagcttgtaatagcagtaataaatattttaataaaatgttttttattctaatggatccatatacgggtgaaattattgtaatggccggcaaaacaatcgataaagcaactggtgaagttagtgattatgcttcagggaattacctagatgcaaataaaatcggttcaacaattaagggaggttcaatttatactggtttcaaagaaggagtaattggaccaaacacttattttgttgatgagccaatcaaaattaaaggaacaaaagctaaaaagtcttggaaatcttttggaactattaatgaagttgatgctctggcttattcatcaaatgtttatatgtttaggatagcaatgcttttaggtggggcaaattatgtttatgatgggccgttgaaaataaatgaagaagcttttgatactttaagaaatgatttaggtgagttagggttaggagttaaaacaggattagatgtttcaaatgaagcattaggatatcgaggaaaacaacgtacaggtgggttgttattagatgcaatgattggtcagtatgatacttacacaaatattcaattagcacaatacgcatgtacattggctaatggcgggaaaagaatccagccccacttacttttagactcatatactactgatgaggatggagaaatacaagttaattatgaggcaaatacaaatgtattagatgatgttagtaatcaagcgacggcgtttagccaaattaaacaaggaatgagagcttgtgttacccgaactgaaggaactgcacattcttggaattcaaaaccatatgtaacttatgctaaaaccggaacagcagaagattatacaactgatgatggtaagactggaacaaccgattatcctaatcatttacaaataggttatgtgcaaacaacggaggattctagaccagaagttgcttttgcttgtatgagttatcgacaaactactgcaacaagtggatctagttctgctccgatcgttgctcaagcagtaattgatcgttactgggagaagtatcactcaacaaattaaaaaaagtgctagtaattatttaaatactatgataatatattagacggaagtttactaatggaggtgtaactaatgagagaaaatatcatttataaatgtactgaatgtggtgaagaaaactatatcaacacaaaaaataaaagaaatcatccagatagaatggaaatcaacaaatactgtccaagatgtaataaaaaaactgtacataaagaaaagaaataagccttattggctttttttctttataggaggaagaagatgaaaataaaaacattactgctaggtaatatgcaaactaatggctatgtggtaagtgatgagaatcatcattgcttaatcattgatcctggagctaatggtaagaaagttgtgcattatttgacggaaaatgaactagttccagaagctgttttattaactcatggacatttcgatcatattggtgcggttgactatttatacgaacattaccactgtcctatctatcttcatcaagacgatttagaaatgctagataatcctcagttaaatttatcagtgtatgaaaatccttttactgttaaagcaccagttcagtcaagccatgaggagatgaagtttggggattttgatgtacaatggctacatttaccaggacattgtccaggatcgtcaatgatttatttaaaagatgaaaatataattttttctggagatgtattgtttaaagggtcaattggacgctttgattttccaaattcatcaaagtatgaaacaatcgaaagcataaataaaataaaggaatatgattttgatgctgttatttatcctggtcatggaccaaactctacgttaagtgaagaacgcctaaataatccatatttaaaaaagtcgtaatttttatagtgaactgcctttgttggacaaaaaataatttaaattaattgtaaggcttgattcctaatttgtataggggttaagccttttctttttactgtaattatagaattattatggtattcgatataatctataatatcttgttttaactcttctaatgatttgaatgtatcttcaaatccataaaacatttcattcttcattttttccaagaagttttctattagtaaattatcctgaccgttccctttcgagactttgattaagtaattcctttttcttttaatttattttaatatgagaaatgttggtactgccatccttgattactatggaaaaatttagagaaagccatatctaacattcggtatgtttgaaatagacttggtgtagttgatatatcgtatcctacgatttttctactatgcatatctaaaattggagataaatataatttactcatagctgttttaaaatcagaaacatcagttgtccatttttgattaaccgatgtagttttaaggtttctattaaaatatgtttttctaatatacttattctctcgtttatcaagaagtaagttcttacaagttccattcatttcccccttataggagttataacgttgcttaggagtaggattaagtgcatataaacccatatgtgacatagtaccactattctttgtttattcgtaagtttggacatataaaaagtgaaccgaataggttggacaacttattcggttcgctataattttttacgatttttttaataattcaattattgtagtattttacaataatgcgtgttgatcgctgtgagtttattttaggaaagaatctcatggttgaaataataaaaaatgagtcatgatataattatcttagtgtaaatatattgcaacttgatattctactagcttatataattaatgaatatattaacttttctgcccgcatgctctttcaaattataaaacctgcttgcaaaaaatgaaagcagcttgcataaaggaatgtggcgttcttattccttcttcggatagaatgttagtgaaaggaagggataacatgaataaaaagaatttgttattgtcagtggcattatcaggaactatgctaatgtccaatggtattaccgcattaacggctcaaaatgctgtatatagtccgggcgtaacggtagagaaaaatactaatccagactgggatgccgattataccgcaacctttgtttatgaagacaaagatgcacgtgacgcagaaagagtaacagtttcaggtaattttcagttttactcattaaatgatccggttgttaaaaattatgaaaaaacagctgatcctaccggagccaaggtttacagtgcttatgactatgataaggataacgcaatgttcaatgtaagtagcggacaaaataacgatacacccatttatgaactggaggaaacaggagacgaaagattcgagattacactgccgttaccgggcaatcagtatttttatgattatacagtagagtatagtgacggttcaaaagttacgattcaggatccggtaaatccatcaaagaaaaacagcttaactgatcatgattcgggacacagtgttttctatgttggaaacagtgaaaatacaacagcaggacaggagtatatttatccaagagctgacggtcaaacagggaaatatgaatttattgaatacaaggatgcacataacacagatgaagaaacacagtcattaggtgtttatctaccatacaactatgatccttcaaaaacatataaaacgatttatgtatcacatggcggtggcggaaatgaagccgaatggatggaaattggttcattgccaaatattatggataatatccttgcggaaaaagaagcagcagaaagtgttgttgtaacaatggataacagtcactttggatgggattatgatttaattgcgaaaaatttcaaagaaaatatcattccgctgattgaagagagatacagcgtatctacgaaagtggaggacagagcgctgtgtggtctatcaatgggagcattgacaacagggacaatcatgttcagttatacagacatgtttggagcgtatggaaatttttcagggacagcagatccactgatttgtaaagactgggagttattaaaaacaaagacagtatatctaactggcgggaatctagatatggctattcaggcgacgcaggaatctggagattcagcatttaacagagggaagacagtaagagcacatgaatatttagaagagctgggagtagagcatttttatgatttaaaatacggttcacatgactggggcgtatggagagatgcatttacaacatttgttaaagatattttatggggttatgaatatcctggagaatctacttatcaagccggtgtgacagtagaagaaaacattaatccagcatatgatggtgattatataacaacttttgtatacgaagatcaagatatcaaggatgcggtcaaggtaactgtttcaggaaatttacaattctattctaaagatgatgaagcggttaaaaactatactcagactttagatttttcacaagcaaaagtatataatgcttacgagtataaagatggaatgtttaatactggctatgggttaaataatgatactgccatttatgaattgacagagacaaaagatgaacgttttgaaattactttaccattaccagggaatctttactactatgactatacagttacttatgctgacggcactacagtaacaattcaagatccagcaaatccgtcactaaaaaatgactacaataatcatgatgctggccacagtttggtgtatgttggttcttcaaagaatactattgatggacaagaatatgtttatgctagagatgataatcaaaaaggaacatattcattcgtaaattatgatgcgattgatggaacaaaacaaccattaggtatatatctaccatataactatgatgctactaaaagctataaaactatttatgtatcacacggtggcggtggtaatgaagttgaatggatgacaattggtgcggttccaaatataatgaataatttattagctgataaagaagtagctgaagcaattgttgtaacaatggataatacatattttggttgggactacgatcaaattaaaaataacttaatgaatcatattattccatttattgaagctaactatagtgtttcaactatcagcaatgatcgtgcattctgtggattatctatgggtggtcttacaacaacgtctatttatacgaccttagcagataaatttggatatttaggaatttggtcagcaactgatccaaatactgatatatcagcaataaaaaatgcggacaaaccaacattattattagcagctggtattgttgattatggtaaagttggatttacaggaaataaagattttgcaggattattagcaaatctagatgaagcaggcattaaatatgattatattgaaacttatggtgctcatgactggggaacatggcgtagtctgtttacaacatttgtaaaagactatttatgggatattaaagaagtaaaggatgagccaacagtaaatcctggagatacgacaaaaccggttgtaagtgtaaaaactggtgataatgttgatataaatggactgttactcatttctggactatcattattaggtatttctattcaatactattgtaaggctcatagaggacattaaaagactatatattttgaagcgaaccccaaaagttggacataaccaacgtgaggggtttttattatggtaaagttaacgagaaaaaagatgctataatttatagagagggattacaaaacccgctataaattataatgagagattatgaagataatccataatctctttaaagtatagtggggaaaatgtccggattatcattcctttcacttttttattttgtggactaatagaataagattcatatttattttgtgaataaatattatcctttttattgacctaaaccttagggcataatatgtaataagcgcaaggagaatgaatgctatgaagaccatgaagttgaagagtggtttcatattaccaagaaagcactcatatattatgaaaaagttggtttaataaaaccagatagagatgataatgactaccgaaattatagtcaaagcgatgctgatagtgtgaaacttattgtatttttaagatcaatgaaaatatcactagaagaaataaaaaaatcaatatatcaatgtatagcagattgggaaaaagatggacgatacaatcatgtcgcttttgtagtcgcatctggaagtaaaatatctagcgggtatgatgatgtaacaattgcacaacatacaagtaactgttgtgctagagtaacctctttcgtaaccggattgggaaatacctctgcagtataaaatttacaatcgaagaactacgaatgagaatatagaaattgaaaaatagttacttgcagattctagtactagataagagtataaaatataggcgctttaaaataatgtagggtgcctaacaaaaagtagggttggaagatgtaatgtcttcattaataaccctattttttatgtgtctagatatattatccaatttatattttatttagatttgttttgcttaaaaggttagaataatcgtatttttttattttttaaaagtaatttctatattacaggcgtaaatgataataggaggtatttttatggatgaactatttgaaaaaatcttaaatcatgcaattaattataagacatcagatattcatattttaatgaagcaaaaatgttctatttcttttcggcaacatggtgatttggtattatatgatacatttgaaagtcatatcggattaaaattatttaattatattcgtttcaagtcaaatatagatattaattatcgtttacgaccacaaacgggtcatttaaattatatttatcaaaatcaaatttactatttacgaatatctagtttacctggtagagaattagatagtattgtaattagaattttaaacaatcatcaacaaattgcccttgataaattgactatttttaaagaaacaactgtttttttaaaacatatcacgactttagaagccggactatttattgtaagtggagcaactggttcaggaaagtcaaccacactatataccctactagattcaattaacgctactcaacaaagaaatattgtcactcttgaagatccagtcgaaataaaaaaggagtattgcttgcaaattcaaataaacgaaaaactaggaattacatataataactctttaaaacaaatcttacgccatgatcctgatgtaataatgataggtgaaatacgcgatgagcaaactgctcgtctagctgttacatgtgcattaacaggccatttagtattaacaacaatccattcgtcaaattgccttacaacaatcagacgtcttttaaacttaggacttttaaaaattgatatagaggatgttttaattggcataatatgccaaaaaatgctctatcacaagtatacacatcagcccttaattttaccagaatatttaaatcgtcaaaaaattttaacttttttcaataatgaacctgttaagtatcaaacatttgaaatgaatgcaaaatatttattaaaaaataatttagttgattatacacaggttgcaggaattatttatgaatgatgatttacaattattagaaaatatcgctaactttttaaaacaaggttatttaatcaaagatgttttaaatttatgtctgataatccatcaaactgaaaaaataaagctgattgaacaaaatttggttgctggtaaagcatttgatgaggttattatagaaattgattttgacaatacatttattgaatactttaaattttttcgatttaaaaataatatttcaactgcaattgagcatagcttaaaaatatgcagaaaaaaggaacaaatatttacacagctaaaaaaagaattaacgtatccagttttactcattatttttttaatgtttttttcattgtttattgtatatggattattaccatcaatcatgcaattgtttgtcgaatttaatattagtccaagtattataactagaattatatttaagctttttgaaattattccaattatagtaattttcattatacttagttttacagtatttttcacaataagtatttatgctattaaaagaaaatattttaaacttattgatttgttaattgaaaaaatagttttaataagaaggttaatccaaaaatactattcactaaaatttgctctgtattataatgaattactgatcaatggctatgattcaactgatattattgtcatgctttatgagcaaatagatgatagtgatattaaaatgataatttacgaaatttatcgacaagttttagaaggagaagctttagaggatataataaatgattttgaatattttgaaccattatttatagcatattttaaattattaattcatgataatcaaaaagataaatcactcgataattatttaagggtatctattgatactttgcatatgcaggtaacgagattgattaaactctttgtaccaataatatattgttttgtggctggttttgtaattttagtttatgttgcaattgttattccgatgatgaatgtagtcagtaatttataggaggtatgaaagatgaaaaggaataatggctttacattgattgagatgattttttgtatttcagtaattttagttattttgttacttgttattcctaatgtaactagtaagaatcgggttgttaaagaaaagagttgtgatgcgcaaatagaagtagttaattcacaaatagttttatacgaaattgaaaacggagaacttccaacaagtattagtgatttgacttctggagaacatccatatttgacagaaaagcaggcaacatgtccaagcggacttaggatttcaatcagtgatggacaagcatatgtacgatgatagcggattcactctgattgaagttgtctttacaattagtataatcttaattttaagtacaattacacttcattttgtaattaattcaaaaccagtaatttctttacagcagcaatgtcaacaggtaatttcattgttagaagaaggaaaaagtagagctatgatcaaccacgagcaaataaatatagttattcaaacaaaacaaattagttataatggacaaaaggatcaacgaactcttacgattaacgacaactattatattgacgattattatgagtttcactttaatcataatggaaatatcagttcgggtggtcatctaaagatttgtagttcaaatggatgtaaaagtataattttaaatgttggaagtggagcattttatgttaaataagcaagggatgacattaattgaaacattgatggctttttctatttttatcagtattatagtattgtttctttcttgttataataatgcaataaatcatcattatcagattaatcaggattatatgaactatttaaaacagcaacaagaaaaggaggtagagctgtggcagacaagtggtttgagcgaatcagtcaacgaggttttacattgattgaagttcttttttctttatcaatatgtttattaattattttaaacagtgtccccattttaagaatagttactgcaaaagataaattatcctttaatctttctagttatgctcttggagttaaacaaatttcatcaattttgcatacggctaaggatattgaaatcaatgatgatttaacttacacaaatgcaaataacgaaatctttactatttcactaaatcatcataggatagtaaaagagccaggttttgatatcattatacacaatgttgatgaattaaatttttatcaaaaaaataagaatatttatatgaaaataatagtcgataataaagaacatgtttatcttattgctactgattatcaaataagtgagaatgaaaaagatgaagttgaaacagtattgtaataatcggggtacgattcttcaagtcgtgttagttatttttattgttttaatcttaaacataagtcttgtttttaataatataatagagaatagccgcagtctagaacgaatcagagaattagatagggcacgtttgttggaaataacaatactgagatattataaagaaacaattttaaatgatcttctttttagtgatgaaataagtattgatgattatttcattaattatacagtggatgatatggggagttactattatattgttacaacaatcaaacaaaatgattcatcatacagttttaatttggagattaatatcgaaacgctagtaatatcatcgtttgattatcaatagttactaaaatcacttcactttatcgatgatttttgatataatcacaaagtaaattacaagtaaggagattttaaaatgattagtgttggagatttaagaccaggaattacttttgaatatgaaggtaacttatatgtagtgcttgattattctcataataaaacagctcgtgcggctgcaaatatcaaagttaaaatgaaaaatatgcgttctggagcaactactgaaattacttttggtggaaatgataaagtaaaaaaagcacatatcgataaacgtaaaatgcaatatttatataattcaggagatgctttagttttcatggataatgaaacttacgaacaaatcgaaattcctgctggaaacttagaatgggaaatgaatttcttaaaagaaagtgatgaagttgaagtaactagttatgaaggagaagtattaggggtatctttaccaattaatgtacctttcactattacagaaactgaaccagcagtaaaaggtgatacagctactggggcaacaaaaaatgcaattatcgaaactggatttcaaattaaagtacctttatttatttctgaaggtgaagttgtcattgttaatacggttgatggaaaatatcaaggaagagcttaacactagtttaactagtgttttttttcatatattttaacttttagcatatattaaagtagttgataaaaggagaaataatatgaatagacaagccattacttttttaaccctatttagtctaattttggtactttcaatttactatattcttctaccacctgaaggtgaagccagtgaagtatctgttaataatgaagaattatcgcaaattgaagtattacaacaaaatttagaaaaagaaagagcagatttaattagtgaaaataatgcaattattgcatcaagtgatagcgatagtaataaaatcgctgctgctttggctaatattagtgaagctaaagaaactgctgctttagaagcaaaaattacaaagataattaatgatgctggttttaagaatgcatttgttgaggttgagaataaaacgattaaagtagttattgataaaaaggaagcaagtagtagtgatgctaacagtattattaaaacagttatggaaaagactaaaaatgagtatcaagttgaagtcaagtttatcagtgagacttgaattttatcttaaatttatatacaatgggagtatataaaggagcatttaatatgagtcaagaatattattcagtagaaaaagaatctaatttaggagctttaaatattggtttgagcgtttttcaagctatagttgtaaaagcagttgagtcagttgatggtgttcaatttgaaggaaatatgatcccaatgcctggaagtgggccagttagaacaaatattaataaaaataaccaagtaattattgatgttgatgtactaattgattatggattgaatgttgcatcagtgactagtgccttacaaaataaaatagctcaaagctgttttgaaatgacaggaatcaaaaatgttaaagtaaatattgaagttaaaggaattaatttttaaggttatcttcggataatcttttttgttttattatgatgcatttcgtttattttaaagtgcaaatatggtaaaatcatgatagatattttggaaggacggattagatgaaaaaatatagaaaaaaaataattagagaaaaagcagtaattgcaacttatcaaaaactgctagtagatacaaatgaagatgagattcgtgaatatttaaacagtgataaggatttatctagcaatcaagatgattttgattattgttttatgtttattataagtattgctagtaacattgaacgttataaagctgaagttgctaaatatttaaaacccggatggacgttagatagattatcaaaaatggaacttgcaattttattagttggatgttatgaacttttagaaactgaacaaagtaaagaagtaatcattaatgaagcggttgaattatcaaaaaaatattgtgatagtgatgcttataaattcattaatggattacttaataggattaaatagtggaaaaacgatatctgacggttagtgcacttaatcgttatttaaaagctaaaattgattctgatagtcaattacagcgaatcttaatcaaaggtgaggtttctaattttaaacatcatagttcaggacatttttattttacgctaaaagatgagcattcaagaataaatgcagtaatgttctcttcaaaagctagtaaagttccttttgatttgaccaatgggatgaaagtacttgttcaagctagtgtgtcagtatatgatgtagcaggcacctatcaattgtatgttgatacaattgaacaagatggattaggaaatttatttttaaaatatgaacaattaaaaaagcagttagctagcgaaggtttatttaaccctgaaaataaattagtaattcctaaatttcctagtaagattgcagttttgtcagcctatcctagtgctgctcttgctgatattattagaaccattcacttgcgttttcctgtcgttcgtgtaatcgtatttccaattccagtccagggtaaggatgcatatttggaaataattagaacacttagatatgttgatacactaggatttagtgaaattattattgcaagaggcggaggttcattagaagacttatggaacttcaacgaggaaggattagctcgagcaatttatcaatgtaagacacctattattagcggtgttggtcatgaagttgattttactatttgtgattttgttgcagattatcgtgctgcaacaccaacggctgcggcaattaaagcaacaccggacttatttgaattacagcaggctgtagacaatataaaatatactttaaataatttaatgaaacaaaaaattatattaaataaagaaaatttaaatcgattaaagtcattctatttatttaaaaatcctcaaaaaatgtttgaagataagacggctaaaattgattatttatatgatcaattaaataatgtttttaaccatgatttgattgaaaaacaaaacaaagcaagcaatttaatacaaacttttaatcatcaagccaatttatttacactaaatcagcgaaatcgtttagatacaattaatcgaacgatgagtcttgagattaaacgtaaattacaacataatcaagaaaagttttattattcattatcaaaattaaatactttatcaccccttaaaacattagaacgtggttatgcaattgttttaaaagaagatcatgttatttcatcagttgatgatttaaatagtggtgataaaattgaattaaaattacataatggcattaaaaaggccattatagaatagaggttaatttatggacaatataacatttgaacaagcaatgagtcgcttagaagaaattattgcggctctcgaaaataaccaaatatcacttgaaaaaagtgtagatttatttcaagagggaataaaactatcaaagatttgtagtgataagttagctagaattgaagataaagtagcaaaaatcttagtggatggaaagttagaagatctaaaaatcgaggaataacatggaaaatttaattgaacaaattaatgaacgattattagaaatcattgaggaatttggcgattctaaagttaaagaagccatgaaatattctttgatggccggtggaaaaaggattcgtccggtaatgatgctgcaggtgattcgtagttatgataaaaattaccaagattatctagatattgcttgtgcaattgagatgatacatacgtattcattgattcatgatgatttaccaggtatggataatgatgatttaagacgtgggcgactaacttgtcataaacaatttgatgaagcaactgccattttagctggcgatgcattattgaatgaagctgttaatgtaattattaaaacaaaagttcctgatgaattaaaaatctcgttgttagcaactttatatcaagccagcggtattaacggaatgattttagggcaagcattggatatggaatacgaaactaaattggctactcgtgatcagttagatttgattcatcaccataaaacaggagacttaatcagtgcagcgatgaaaatgggagcgttaattgctaatcccgatgaccaaaaaacatgggtagaaatcggttataagattggtttagcttttcaaattcaagatgatgttttagatgtagttggtgatagtagtttattaggaaaaaaagttggtagtgatcaagtaaatcataaatctacatatgtaactttgatgggagtagaacaatctcaaatgattgttgagcaatattttaaagaagcaatggaattaatttataaattaaagattaatcatggattaattctagaaataatggaaaaattaaagaaaagagtgaaataatggatctagaaaaaattacagatccctcttttttaaaagagctggatattagacaattgaatcaattagccgatgatatccgcaaatttttgattaataatatttcaaaaacgggaggacatctttcgagtaacttaggagttgtagaattgagcattgcactgcattatgtttttaattcccctaaagataaaattttctttgatgtaggacaccagtcttatgttcataaaattttaacgggacgtgctggtcaattttctacactacgccaatataagggactttcaggctttcaaaagcgttgtgaaagtgaacatgacccttgggaagctggtcattcctcaactgcattaagcggggccttgggaatggcagtagcaagagacttgaatcatgaaaattatcatattttacctgtgattggcgatgctgcaatggttgggggtgaatctttagaagcattaaatcatcttggctcaattaataataaagtgattattattttaaatgacaaccaaatggcaattggtaaaagtgttggtggttttggtgattttttatcttcaataagaattagtggtacatataataatttaaaagaggattatcgcaatattacttcgcacaataaaataggtaagatgatttttaatgtttccaaacgagttaaagattttgttaagcatggattgattgatgatacaatttttgaagattttggggttgattatctgggtccggtaaatggtcatgattttgatgatctaattagggttttaaatttagctaaaagtgcaaaaactagtgttgtagttcacgtggttacgaaaaaagggcgtggctataaatacgccgaaaatgatattgccggtaaatggcatgggattgccccattcaatattgaagacggaactatgaaaggtgcgggaactagttcgaaaataagttggtcaaaaatggttgctgatcatattgaaaggcagatgaaatcagatcaggatattgttgctattacccctgccatgattcatggttctgcaatggataatatttttatgcattatcctgagcgaagttttgatgttggaattgctgaagagcatgctttgacttttacagcagggttagcaatttctcaaaaaaagccatttatttctatctattcttcatttttacaacgtgcatatgatcaaataaatcatgatattgcaagaatggatctgggctgcttgatttgtgttgatcgctgtggatttgttggagcagacggacctacacatcatggtgtttttgatttaggaatattaacacctctgccaaatgtaataatttgtactccaagtaatagttatgatgctaaacgctttattaacacatatttaaagaataacgatcatccttacattttaagaatccctcgaggcgatattgaagatatgaatgtaggtgatgagcttttaactattggtaaatggcaagttgtaaatcgaaaagattacgatgtaacaattatttgttatggtcaaaacgttaacttgattcgtgaattttttaaagataaagagataaaagttagaattattgatgctttatttattaaacctatggatgaagatatgttaaatgaaattattgatgaaaaaccgttgattgtttatgaaacagaattaaaaactggttctttagctagtaatattgcttattattatagccaaaataatattttaaaacggattcatagttttggagtagatgaccactattctgttcaaggaacagttgcacaaattttacaagatgagggtttagatatggatactttttatcaaaaagttaaggagatactaaatgaagaaggaaagaattgatgttttattagtcgaacagggcttttttgattctcgtgaaaaagctaaacgcgcgattatggccgggattgttcatgatgattatgatattattgataaaccgggaacaaaaattccaatagattcaaatcttcatgttaaaggaaacataatgccatatgtgtcacgtggtggcttaaaactggaacgtgccttaaaggagtttgaattagatataacggatagaataatggtcgatatcggcagttcaacaggtgggtttaccgattgtgctttacagaatggtgtaaaactagtttatgcaattgatgttggaaccaatcaattagtttggaaattacgcaatgatccacgtgttattgtaaaagaacaaacaaattttagatatgcaacaagtgaactgtttgaacatggaattcctacttttgcttcaattgatgtatcttttatttctttgaagtatatttttgatgcattaaaaaatattttacatagtggtaatcaagttgtagcactaatcaaaccgcagtttgaagctggacgtgaagaagttgggaaaaagggaatagtcaaagaaccatctgtccatcaaaaagtaattcaacatgttattgaatatgcaaatcatgatggctttgttttagaaaagttaacttattcgccaataactggtggtgaagggaatatcgagtttctagggctttttgttaaagatggtaataatgttgccattgacatagaaagagttgtagaaacagcacataattgttttaaagggtaggtgagataatgttagagagtatatatattgaaaattttgctattatcgaccgtcttgaagtcgattttcataatcatatgactgttcttacgggagaaactggggcaggaaaatcaattattattgatgcgattggtcaattaatgggaaatcgtagtcaatcaagttttattaaagctgattgtgatgaatgttttattgagggtgtttttacaattggtgctaagtcaccagtcttaaataaattaaaagaatatcgtattgattatgaagataaattagttgtttcaaaatcttttaatcgtgataataaatcgattattaaaattaattatcgtaatgtttcaaaaatggtattacaatcaatcatggctgatttaattgatattcattcacaatttgaaacccatagtctttttgatgctgaaaatcatttaattattttagatgagttcattaatcagcctttaaaaaaattatttcagacatactcactagcatatcgtacttatagagaaataaatcgtgactatcaaaaagcattaaacgaagagctgagtgatgagcaattagaattttatcaagctcaattagctgaaattaatagtcttgatcttgaagaattagatgaagatgagttagaacgtgaaaaaaaactgcttcaaagttatgagaaaacaaatgagcaaatttctaaatatcgacaatatatgaatggtgatcgtggtgctctagcaacattaagcaatgcattaagcgaattagaagaattaaacgataatcctcaatatcaaaatacgtatgaaaggatgtatgacctatattataatttaattgatcttgatgatgaaataatcaatgaatttaatagtactaattttgatgaatatcgtttaaatgaaattcaagaagtcttttttaaattaaatcgtttaaaaagaaagtacggacaatcaattgaggcgattaaagaagctaaagaagatttagaaatgaaagttgcagcttttaacaatcgggaaacatatttgaatgatttaaaaaaacaattggatattgcttatcaagagaccaaatcaatagctgagcaaattactagattaaggcaatcaaaagctaaagaatttactgaattagttacaaaagaattaaaatctttatatttagataaagttgtttttaaggttgattttaaattagttgattttcaaaaaaatggacaagataatgtagaattcttaatttctacaaatgctggacaaacattaaaaccgttgaataaagtagcttcaggtggagaaatgtccagaattatgttggcaatcaagatattgtccttatcttcgagctctgtggaaacaattatttttgatgaagctgatactggcgttagtggtaaagtggctgaaagtattggagcaaagatgaaatatattagcaagcagcatcaagtattgtgcattactcatttagcacaagttgccgcttttgctaaaaatcattatttgatccaaaaatcaagtaatgacaattatacaaatgtaaagattaaagaattatcttatgatcaaagtattaatgaaattgctaaattgatttctggaaaagaagtatctcaggaatcaataaatcatgcaaaaaaattaaaaataagtagtgaataattaaaagcatagaaaccaaactatgatgtaacgaatgttacaaggaggtttctatgctttttaaaaagctaatcctttcctttatcttagctttagccattattaatccaattgcaatatatgctatttctctagtacctggtggagattccattggaatcgagctagattatcaaggtgtggttattacaggaggatataagatcaaagtcggtaatgaaagctacgatccactagcaaaagattttaaagttggagatattattgtcgcaattaacaatcaaaaggtaacaagtattgaagaattaagcaatgttattaaagaaggcgatatagctaatcccagatatgatttaaccattaaaagaggtaaagaaaccctccaccacgacctccaggtcgtttatgaaaatcagcaattttctacgggattatatgtcaaagatgcaattagcggggttggaacacttacattttataacccggcaactagtacttttggagctttaggacatgcaatgagtgactctaaacttgacagcgaagagcttattcaaaatggtaatatttttgaaagtacagtaactagtattaaaaaagcaacaacgcaatcttcaggaaataaaattgcagacatttccaatattgaaataggtagtataaacagccatagtcaatttggtatttatggaacttataattatgatatttcaaaacgagaaatgatggaaactgcatctattgaagaaactaaattaggaaaagcctactttttaactgttttagatggtgataaaatccagaagtgtgaaattgaaatcactaaattgaatgaccaggattctataaaagaaaagggaattgaatttactgtgacagatcaagaagtaattaataaagctaatggaattgtacaaggaatgagtggatcaccgattattcaaaataacaaaatagttgggtgtgtgactcatgtatcaggtaataatccaattattggctatggtctatatatagattggatgcttgagatggataaataaggataaaaaggtgctcaaattgagcacctttttatttcaatttggtgagatttttagtataattatacagttaagggggaaacatgatgaatttattaacgataaaaagtgcatttaaagaaagtatccccgttatgatgggatatttagtcttaggatttgcttttggaatgttgcttgtttctaaaggatttccaatttattatgcatttattatgagctgttttatatatgcgggaagtatgcagtttgtaacaatttctttattagctggtcaagcttcttttattagttcatttattatgacactgatggttaatgcaaggcatttagtttatggattatcaatgttaaaaaaatttaattttttagggaaattaaaaccttatatgattttttcattaacggatgaaacattttctttacttgtgaaaaatgattttaaaagtaagaatgaggtttttttaataagttttttagatcaatgctattggatcattggttctttggtgggggcaacaattggaaataatgtatcttttaatactcaaggtttagaattttcaatgacagcattgtttatagttattgtaattaatcaaattaaaaataattctaatcatttagcgacattgattggtttttttgtcagcataatttgtttgattatttttggtagtgataactttgttattttttctatgattttaatcatgataatattaattttagttaaaccgaggttaaaaaatgaataatgatgtcttgataataatagcagtagctttaggaacaatcttaacaagggtcttaccatttctgatatttaatgatgctgaaaatttaccaccggcaattagttatttatctaaagtgttgccatattcaattatggcaatgttagttgtatattgtttaagggatacaacttttatttccggaaatcatggttttccagaaataattgccgtttcaattaccattataattcatttattaaaggaaaatactttattatcgattttagtaggcacaattacatatatgatttgcattcaagtgatttttgcataaaggaggtatagtaatgcaagttgttttccacattgatcttaatgcattttacgcaagtgcagaaatatcacgtaatcctgacttaaaaggaaaaccaatagttatatctggtaaatcacgacgaagtattattaccacagcttcttatgaagcccgtgaatttggcattcactctgcaatgccactatttcaagcattagaattgtgcaaagatttaattgttttacctgccgattttgaattatatcatcgtttatctaatgattttttttcaatagtagcttcttatagcgaaattttagaggttgctagtattgatgaatgctatgtagatgtaactaaaataattatagataaacagattcatccaatattacttgctaaagaaattcaaaaaaatatatatgaacatttaagtttacgctgttctattggaatcgcaccgaataaatttttagcaaaaatggcaagcgatatgaaaaaaccaatgggaattactatacttacaaggtctaatttaaaagaaataatgtggccattagatattaaggatatgtttggaattggtaaaaaaactcagccaaagcttaaagcagtaggaattaatacaattggtgatattgcaaattatgataactataataaactaagacaaattattggcaaaaatgcgctactattgtatcgtaaagccaatggaattgataatagcgctgttgatgctaaacaaaatgaattaaagtctgtaggaaactcaactactttaccatatgatacaaatgatgaggaaatactaagggatacattaaagagtttagctcgccaagtttcagcgcgagctaataagcgcaacttaatttcaaattcaatctcgattactataaaatatactcgctttgaaagtgttactagacaaactactgtcaattcatttattaatgattatgaaaccatattatctactgcaaaaatgttatttgatgctaattatagcggtcgacctgtgcgtcttttaggcatcagtttaaataatacaatcaataagaagaactacaaagaacaacttaatatttttgaaatggcgcaagaggatgaaaccaatgatgattctcttgaacagttactaaatgctatcaataataaatttgataagaagctggtgactaaagcttcatcatttgcaaaaaagactccccaaaagaaatatttaaaataaaagaataaaataatgatttgctcataagttgtataaacggaggataacttatgagcattttaaataaagtttttagaaatgaaaaagttttaattaatatattttctgcaatattatttgtttttggtatcttatttggcattatttattatttttatggtaatgaagccctattaaatttatgtaaatatatcttttttttcaaagataatgagacaaccaataattataatctatatattacaattactagtttctacatatttttatctctaataatttcaactagttttttaggaacaatttttaatagttttgttatttttacaaaaggaatgcaattatcgattgcaagtattttttattttactttaaatacgtttgatgcatctatgctttttttaggtttttttccacaattaattattgaattagcattaacttatattatttctataatttctattagattatcaataaattgttttacaatttcatttttgacaacagaagtatttaatagtcgaaaaataattaattatatcttagattacgtaataattatcttaataatagtcacattatcaatggcatttaaggtttatgcactttagttagcaaatcgttagtatggttaaatttaaacgtgatataattattaagtgaaggtgaggtgaaagtaagtgtagtacttgctaaatttatgttaattaaagatgccttaagtgaatataagcaatatttgattgttgaaaaaggtttgagtaagaatactatttattcttatctacgagatttgattgctttttctaattttatcggtgaggaatatgaaattaatcaaattgaaaatattaataaagaacatattcatctttatttaaaggagttatcgaaaacaaactgtactaattcaatttctcgtaaacttgtttctttacgaatgttatatatttttttagtgaaagaaaatattgtgaaagaaaatctcatgagtagttttaccttaccgaaaagagataaaaaattacctattgttttgtctcaagaagaaatgatagagatacttgatgggatcattgtttgtgatgcaattagttcgagaaatagatgtatggttgaattgctatatgcaacgggtatgcgtatttcagaattgttgaatcttactttgaaagatttaaatattaaaatgggatttatcaaagttattggaaaaggaaacaaagagagaatgattccaatcggttcatatgttggagagatattggaacaatacataaatgattatcgagctgaatttaatataaaaaatgatagtttattattttttaataagcatggtcaaagattaagtagagaagaattttattctatattacaaacaattgtaaattcaacttctataactaaaaaagtctcgcctcatacttttcggcatacgtttgcaactcatcttttagaaaatggtgctgatttgcgttctattcaagaattgcttggccacagtgatattagtacaacaactatttatacacatatttcgaatcaaaagattagaagtgagtatcagcaattccacccacgcataaaaaagcataatgatgggtaaaataatgtctagatatggaaacaatttaatgatatacttatgattgcgtaaaaagtgacgcaaggaatggaggacaagatgaaatacaacagagtttttttaattgtgtgtgattccttaggaattggtaatgcaaaagatgctaatttatataacgatgaaggatcaaatactttaaaacatatatgtaatgcctgcaatggccttgatttaccaaatttggaaggattaggattaggaagtttgggtaatttttctggaatacatcaattaacttcacaattaggatatactttagctttaaacgagatttctaatggtaaagatactatgaccggtcattgggaaatgatggggcttaaaactgaaaaaccatttattacatttaccgaaaccggctttcctcaagaatttattgaactttttgaagaaaaaactggacgtaaatgtgttggcaataaggctgcaagtggtacagcaattcttgatgagtatggtgaacatcagataaaaacaggtgattggatcgtatatacttcagctgattcagtttttcaaatagctgcaaatgaagagattatcccgttagaagaattgtataaagcatgcgaaattgctcgtgaaatagccatggatgagcgttggaaagttggtagagttattgctcgaccatatgtaggaaaaagggtagggaaattcaaacgtactgccaatcgtcatgatttggccttagcaccatttggacggactgttcttgataatttgaaagataaacagtttgatgttattggagttgggaaaattccggatatttttgttgatcaaggaattactaaagcagttaagacggtaagtaatcaggatggaatggaaaaaactgttgaacttgcaaaatcagaatttaaaggattgtgttttgttaatcttgtagattttgatgcagtatacggtcatcggcgtaatcctgagggctatgggcaagcaattgtagattttgataagcaattggaggaattaatgaaatatttaaatcatgatgatttattaatgatcactgctgatcatggtaatgatccaacttatagtggtactgatcatactcgtgaacaagttccattaattatttattcaaaggaattattgaagccacgtcatttacatgatatggaatcttttgctgtaattggtgctacaattgcagataattttggtatcgaattaccaactattggccaatcaattttagaattaattaaataggagaatttatggaagataatacaaaacgattgatcgtgatgtcaattttagcttatgcaattggaacgtttatctttgctgcaggattaatgaccaagacagccgttagcataatattattttatataattgcaagcatattaataatttgcggtattttagcattatataataattataaaaaaaatcatcaaattaaattatacttatacttaatagtggtaggaattgttttcttgtttttaaatacaacggcattaattaataacttatagtttataaaagcattctaagattattggaatgcttttaattaggatttatcgatcaatttatttgtgtttgtctattaaaaatcaattataaaatttacataatatacattatgcgaagtagtatatattcaaaaaaattaaattttatctttgataaggttaactaagtcgttagccttttccacatttaaataatgatcataatagtcagctttaagaaacatagttaaatgaggtctagcaatacccgtctctttacaaaaagatgtaagattaagatattgttttctttcattgataaattcacgacattcgcttttagataacataggcaacactcctttataatataagtgttcgcatatgtatattatgtaatgtataagtatataattaacttacaaattaaatatatcataaataaaactttatgtaaatataattacataaagttgattaaattatttatataatacaatattgccaatataatttatataattaaacatactaattttttttatacataaatagtcaacttcattatgaataagcaaatcataaacaatagcaaatctttcaaaatcaacacaataaatatatttaatagtttttttaacaatataactaatacaatagtattcataagttctcatattaatcacctcataaataaattataataaatttatttcttatttactatttttatataacaaaaatcattctcatataaaccatcttcgtccaaaaagaaatctatatctacctctttattatatataactttaggttcactaattaaaccattactacagtaataatatttactaaatatcctatcttccatttttgtaatatacttactaatataactagaaattttagaatgactttccaaccctttatctattttaaccgcagtattataacctttattatcttgccatgaaacaatattatatacatctctatccgttttactttttatatttgcatttaccaattgcattttattattactatcccgtattagcccgtgccaatgcaaagcaccgtccttatgcagttcgggaacaattatatacttaataccatgtttcttagactgattttttaaatactctagtgttcttttttttaaatcttccaaattatacctatcttctactttatccttagaaaatgtaagagttataaaataatcccaatcattgagaatagccatattaaacaccttagacttagaacgtctcttagaccttgcaatattatatttcctaatatcttcataatcataaagcaaacccaactttttaagaaacctgtctaaatcagttaaaccgtcattgtaaaccgatatatcatacttaccgtctttatcctcttctatatagtccctaatcttgacattattcttaaaaagtatttgcttttcaaaagacccgtaatcttttacaacgtagttagtatagacgttacattctttatcatgcaatccacttaaatctataacaatcacctacaatctagggggtaccccgatagtgtccctatatcaagtaagggacacgcctttaaaccatttttttcactcgccgttaggcgtcctaaagtgtatatatacactttagggttgcaacagtgtttatgccttacacttccacaacaacaaaagtgcataaccgctgcgcttttataacttttgcggttgtgtcgttgtcggctacgtattataatttagaacctactcggctcgctttgctcgtggaccctcgttggatctaaattaaaatactatgtttttaatttttcaccattatcccaaccataagaattatatagagaacgtatataatcactttgaatgaacttaattttcttgaacgggtgtatcttcatttttttattaatatcgacttcctcataaagtgctttataatcatagtcccgataccaccgaacttttgtatatcgtccaaatatagtcttgcacactccatattcgatagttaatctacgaatagtcttatgtactaattcgtggtcttgactagcccaatagaacattttgccattacctttgcggtttaaggacaatgcttgtcttatctctttaggaaataccttatcagtagcggggaattcattttgaacttcgtcccacataaatactataggtttatcgtactgcacacccgtttgtctaacatcattaaactcaaaatcttggattgacaaaccgaaattagtacaaatataaatatcatttccatgtttattccttaaatttaaagcaattttagtcattgccatagtttttccacaaccatacatacccgttaaacaacgtacaccgtacatgtgcaattttttaccatattttttaaatctatataaatcaattaatttccattttattaaatctaaaagtattatcttaaattcaaattcctttatcttttgtttagtttcatttttcataaaaaacccctttatataaatactgttgttaatacactgcgccgtagaacgttgcgcagtgtattaattaacaccaggtatctttatatatacccattctataattgcccaaagtatatcaatgctagcccacaacactacactagcgaataccattgcaaacggcgaactgccaaagaaatatataccatactgcaacaaatcataaaatacacttgtaatagagccttgctcactattcatcttaggtaaaagaccaataagaaaatttgcaaagccaaagaaaacttttagcaccaattcagttatcatttttcgctacctaccttattattagcattttgaccactatgtccgtctccctctattggtttagattttctaattaaaaacaaaacgtgagaataatggtaccaacacaagaatatagcaactaaccccgtacctaatgcacgagtataaggctgagcataagaaaggaaagataagtctatagactgtctatgtccaaagattgtaaaaactataggagtaaatatatcgcccctaacctctttagttttagtaagactatctaatatacttaaatctataccaattttattactaagagtatcttgtatagttttaaaattactatctagaaaattatcactaggaacaaatagaccttttaataaatttcctaacaactctagaaaatagctaagaacttcccctaaaacatcaaagaaagtacctataaaatcaaataaaggctgaaaaataagtttgattaagttaccaatagctgaagttaaagaagaaacaagaccaccaagaaaatctaaaactttacctactgcacccgttactttatcaactgaaccaacaacaaaatcaaagccaccgcttattaaaccgccaatcgtatcgaacgccgaaccaagaaaatcagtaagcccgccgaaaatatcgccaaaccaaccggtaatatcttcccaccatccgctactatcttccccggaatctccgccactacctccggacggataaccggttccactaatagcgccgcatgaaaacccatagaattaatcctatctaacaacgtagtatcattggtttcatagcgaaatgaagcattagaattattgacctctgctacaccaacattagcagttgtagcgtcgaaccaaccatcagcagaattataaatagcatcaccaacaaatgaaatattaagaacaggtttaccaccgtaagaaccttccttaaaagtggcgctattataataataaaattctatttccttatcattttttaataaaataaaacaatacttgtactctttatcttgaaccgtataagcattaacactagaaccagtaataaatatagaactaaatacaatacctaaagtaagaagtattttttcaattttgtgattttccttaaatttaagaatatgatcacgcgcattttttataattttcataaatttttatcctttctataaaattaaagggctaggaataaatatcctaacccaatataagaagttaatcttataagaatttataaacaattcttgggataagactaacgccaatcataattcccatgattgtaatgccgacaggtaataaaatacctaaatccgaattaatactgtcagtaatcggctttaacatttcagcagttaacatttttgatttcctccttatataaaatttcttaagaatttataaaacataactaagaagaatacagctagagcaacaacaagacccaagtaaacaacattattatttaattgtgtattgtattgaagtgtttccaagttatggtttatactttgtaactcaaccaataattggtcttgattgtctaactgttggttagacgtttcgttttgcatttgggcttgttcatcttttgtataaaaatactgactaagcagttgattaagtacctcaatatcaatgcttgatgtttcatcaactgaagtgccctcttgaatatcttcatccatagtcacctgttacctttcagcaatccataaattgtaccaataactaaagcacctacaaaaagccatatcatactcatattattgacctcgtttaatgaaaccacatacattgacataatttccatttttacgataattgaaatcgccctctaaacctaacatagaaacagtttttaaaccttcgcacatctgttcataagcaactggtgtaagccattcataaccgcacaaactgccttcaacattatccttaccatgctccatatcgttataatggacttttacacccgtaacatgtttaccttgtttattttcataatctaaactttcaattcctacaatcttaatcattttctttttcctcttttctttatttttcatttaattaaataagaatactttatgtaagaataattacgtatgtatacattatgcgaagttatatatgttatatctactttactaattataagaggtaaggagtttttaatattccttacctttcttgattttatccatttcaaatgaatcatataaatttgttacatattcaccattgaaacaagctaaacataaactacatttatgtttttctttattaaaatggatagatttatcaattccttcttcagtaataaaggcaagtgaatcagcttcaatataattgcataattcattaacattcaaacgattagaaattaattcgtccatggttgacatatcaacaccataaaaacaaggatatttgattgctggtgaagcaattcttacatgcacttctctagcaccagcttcttttaacaatcgtacaattcttttagaggtagttccacgtacaattgaatcatcaatcataacaacacgttttcctttaacaattgaagaaactgcagataatttcattcgaaccccctgctctctcatttcttgagtaggttgaataaaagtacgacctacatatttattcttaatcagacccatttcataaggaatattagctgcttctgcatatccgattgcagcagaaatagaagaatcaggaacaccaataactaaatcagcttctactggtgcttctttaaataattgtttaccagcaagttttctagttgtatgaacatttattccatctaaattactatctggtcgtgaaaaataaatatattccattgcacatattttatcagtaacatcatttgtataaagctttgatttgatttgaccgtctttgactctaacgatttcaccaggttctaaatcacgaacaaattttgcaccaacaacttcaaatgcacacgtttctgatgaaaatacatatgccccattaggcaattgaccaatagaaacaggtcgcaaaccatacttatctcttgctacatacaaagcattctcaatcaaaatcaaaaaggcaaatgcaccatcaagtttgtttaaggaattacaaatacgatcaatcatatgaccttcttcacgcataattaaatgacctaaaatctcagtatctgaagaactagaaaaaatgcttccttttttttctaagtccgcctttaagacattggcattaacaatatttccattgtgtgcaattcctaaagatccatttaaggttctaaataataatggctgaacattagcaattccaccaccaccagctgttgaataacgaacatgaccaatagcatgatcacctttcattttgctaattttatcttgatcaaatacttcagtaactagcccttcacccttttgaattgacaaagcttctttattttttacaacaataccagcagcttcttgcccccggtgttgtaaactatgtaatccatagtagcacattgctgcagcattttcatatccacaaactgcaaatactccacattcctcatgtaattctcgatcttttgaaaacattaactaacctcctcttaaatacttttacattttataatgcagagataggttagtcaataaaaaataggtattataggcactcatttatataaaatttattatcttgacaactattttttaaaaaattggtcaacattgtacatatatacgtacaatcaccaattatttcattgtttaaatcactttcaataatcagttctttgtttgtttttgataagaaacaaacgattttatttagactttcataattagtatagattatttcactgacctcaattttagaagcactttcatgataaattgcatatccaattattttagcattatcataaaataattttatttgatcgttataagcacggcaacgtgcaattaagtaattttggtaatagtcgatatctcttttacgataaccattaaaatcttttgtgaaatcattatataatttaagtgaatttacaaaatccagatcttcaataactgttaaatcataatcattttgatatgattttttgtcaacatttgtaattttatgataataatctttattaaatccaaaattataataaatttctggcatgtaagcttgaagtaaaatcttttgaccagcatattttggcaagttaagcacatagttcattaactttttcatcattccttgcttttgataattcttattagtagcaacaccaagaataaagtatgcctttatctcctgattatccagaacaatggtatatgggactatttgcatcattgaaacaaggaagttgttattttttaatagatatgtattttctttgctgtaacatttcataaaataaaagttagttgtttgcttgtcttcatcttcaaaactatcacgccataggtcaataattgaatgcagatcattatctgctgccggcataattgataggttactaggaacaatattatatttcttaaccattttaactgggtgcagcatttgtttagcacggcgtagtgattctaatcccatatcttcctcacggttaacaaattcataaccctcaaaatttcgttctaggaagaatttaccaatcgccacatataatcctctaatatctttattagccttctctacgtgaatttgaacggtactgtgtttaagtggggaaccaataataaatgcttctaactgtccgttaatgtaaatacagccagtttttatttccaattcatgacgatgtactaacaagtagacaatcccgatatactcagaaataacactctcttctattcgatgagaaaaatcccattttttgagacactgtaaaacattatcaacatcttcatcttcaatttctttataaatataattcggattttctttaacaaacgcattaaagtgatttcttctcttttgcattttttttcctgccaaagattctagagatttttttgtatagacataatcatcaaaatcttcattatgcaaatacaaaaacttatctccatatctttctttaattaaactcatagattcttcaacagctaaatcgattctaaaaagaaagttatgctctttagcatagttttgcatatattcgattgcttcatagtagtactctggtttgcaaaaaggcattgcaaaaaacttttcgtctaaatatgtgtgtaacataaccatgaaattatcttttatttcataatatatttcatattcatgatcccacatcatcattgtgacaaaattagaattatagccctcataatttgcatcgtctaaatatttttttattttgtgataatcgtttaataataattttcgcatattactcctattgttttatttacctagcattgcattaataaattgtttggcagttcttcctgaaaatccaccgtgacgaatttcccaagttaatgctttttgatgcaattcgttacgctccatcattaaaccatattgttcggctaaaccatcaacaatatctaaataattttgacgatctggatgcataaataaaattttaacaccaaatcttgaacttaatgatgttttttcttgtttagcatcatttacattaacctcatcctgatcttgacgatcaccccatgtttgttttactaaatgacggcgattacttgttgcataaatcaaaatattatcaggtttcttttctaacccgccttcaatgactgcttttaagtatttatactcaatttcaaattcctcaaacgataaatcatccatgaataatacaaatttataattacgtgactgtaattcttgaataatactaggaagatttataaactgatgtttataaacttctatcattcttagaccatctttataatattcgtttaataaagctttaatactacttgatttaccagttccactatcaccgtataataaaacattgtttgctttttttcctgctaaaaatgcctcggtattttgggtaagtttttctttttggctttcataaccaatcaactgatctagtcgcccattacctatatgtattataggactaatttgctcattttcataacgaaatgctttatttaatccaaattttccaactccatacgttaaaaagaagttttctaatacattataaaatgattcaacatcattacaggcagttaaattgtcctgtaatgtttttgaaacttcgaatagttcaatattaatgacaggctttgaaggtgtgaatcctgttatcaaattttgttgtgctaatggcaagacactaaaatccgtattaaacattttgaaaataatcttaaaatcattcataacaatttcttttaaattagcagctattgttttttttctttctaatgctagagtaaacgaattttcattattaattaacaaataagttaataaactattaaatagattatcgtacaagttgtatttttcagctaatttaattaacaatgaaacaaatttactgctattttcaagtttcccatctactacttcagtatataatgcaaaacactcagcaatatctttatttttatacaatggattaaaaactattaaatcattcattttacattttcctttcaatataatgaaaaagacgagttaacgtcttttaatttttaaaactatgaattggtgcaggaattctaccaccacgattaataaattcagcacatccaaattggtttactggcattacaggtgcataacccaatagtcccccaaattctactacttcaccaacatttttaccgattacaggaataattctaacagctgtggttttttgattgatcataccaattgccatttcatcggcaatgattccagataaagtagtgactggagtatctccaggaatcgcaatcatatcaagtccaactgaacatacacatgtcatagcttctaatttttcaagtgttaatgcgccacggtttacagcatcaatcataccttgatcttcactgactggaataaatgctccacttaatccaccaacatatgaagaagccataacgccacctttttaacttgatcattcaagattgctaatgcagctgttgttcctggagcaccaacactatccaagcccattccttctaaacaatcggcgatactatcaccgattgctggagttggagctaatgataaatcgatgattccaaaaggaatccccaatttttccgacgcttctaaagcaactaattgacctacgcgagtaattttaaacgcagttttcttgataatttcacataactctccaaaatcttttcctttggcattggcaatagcatttttaacaacacccgggccactaactccaacattgataattgcgtctgcttcactaaccccatggaaagccccagccataaatggattatcgtcaggtgcattgcataaaacaactaacttagcacaaccaatagaatcattttccttagttaaatctgcagtttcatgaatgatttcccccattaattttactgcatccatattaataccagttttagttgatccaacatttaccgaactacaaacattactagtaactttcattgcttcaggaattgaacgaattaataattcttccgcctttgtcattcctttggaaacaattgctgtataaccaccgatgaaattaactccagtttcatgagcacatttatccaatgttttagcaattttaacaaagtccgctgttgatttgcaagcattagagccaacaaatccaattggtgttactgaaattcttttattgacaataggaattccatatttcatttcgatttgtttacccgtagagactagattcttagctacggtagtaatttttttataaatattttcacataaaacatcaatatcatgatccatacagtctaataaactgatccctaatgtaattgttctcacatcaagattttcttgctcaatcattttatttgtttctgctacttcaaataaattaatcattccgattctccttaaatacgatgcattttattaaaaatgttttcatgttgtaatttaatatttactccgatttcttcacctaatttatctaaatcttcacagatagttccaaattcttcggtaattgaacttagttctacaatcatcatcatgttaaaataaccttgaatgatagtttgagaaatatccaagatattaacttgtttttccgctaaaaaactacaaaccttagcaataattcctacttgatcttttcctactactgtaataatccccttttgcatactattacctacctcctaattatttaggatattatatcatagttgtatacaatataaaacccctatttcttgaaatttcgtcaaaataaaaacggataaattttatccgtttttatttaatcgtaaggaattatcttcccattaattttttagcaaattcgtaaacagctttaccattcatcattccgtaatctttcatttcaattacatcataaggaatatcttttccagtatctgcaataattttttcaacttctttttttgcatatctaacttgtgggccaagtaatacacaatctacagtatcaataattttttcaccttctgtcaaaggtaaagcaaagatttctacttcttctccagcttcttttgctgctacttccatttttgttactaataaactagtagacatacctgcagcacatactaacataattcttgttgccataactaactctctcctttattgttaaatttcatataaaaagggcatcacaaaaaacgcccgttttatcttttgttatttcagtttaagctttttgattacccaatcattttcattgcagcttcaaatacagctttaccgttcatagttccataatctctcatatcgattacatcaacagggatagctcctgctttacgtccagcagccaatttttcaatagcagctttttggaatctaacttgtgggccaagtaaaatacaatctacttcttctaatactcttggtgcatcagagaatggtaatgcaaaaattttacattcaacacctgcatctttagcagcaccttccatttttgttactagtaagctagtagacatacctgctgaacacactaataaaatagttttcataataatatacactcctttttttttacctaaattaattttacaccgaatggcttagaatgtaaacactttcttggctgaaatgctttatttttttacaattaaaaatgaattttttagtaaaaaataacttctactcttagttaataaatcttaccattttaaaattttccttgttagaatcatcaatttttaaagctctttaacaccgtttttttgaagtggaattataaaaaaagaatctaaaaattttaatttttcttttataaaatatttcaaataaatctttttttatagtataacagacgctattcttctgtacttgtctagaccattggtgtcaaagaataattatctttatttttatcctttttcaaatatgttatgatagataaagaaggaagtgattttacatgcaggtattagtaattagtgatactcatttacaaaatgaattatttcaaaaaattaatcaaacatatcctaagatggattattatttacattgtggagattcatccttaaaaaaagatgatttcttgttaaacaaatattatactgtaaaaggtaatcatgatgatgaagattttccagtcaatattattttagaaattggaaaatatcgctgtttaattactcatggaaatgcttacgatatatactacggaaatgataaaataaagcaatatatgattgctaataatattgatatctgttttcacggacatactcatgttcctgcatatacccaaattggtaaccgttatattattaatccaggcagtgtgatgatcaatcgaggttcatatggtttcggaacctttgcaatcgtggaaatcggtgatactataaaagtaaattattataatagtgaaacttttgaagaatgctcaaaaatggttctagacgatggaaaaatcgttttagaagaatttaagcaaatactaaaatagaagtgagatttaaaatttctcacttctatttttttcttcatttcgcttacgcttatattcaatcataaacattacttcttttaaatcttcatccggtaactctgttaacaaccgtgcgatattagcaatattatagtagtcgtattttttaccactcattatttcttctacacttcgtccatacaagttagaaaatattcttaattcccctactgtaatatccctcttaccattttcaatatctgaaatggctgaatgtggtacttttaaataagcagcaacatccttttgtgtcaggtgtttgaaattccgataagattttaatcgtgccgctaaatctttatcaatcatcattatacctccgataaatagattttagcattttccttatttttcttcaataagattttgtatatttataatttatttcgacaaataataatttttatttatataattagataattagtcataaaaatatccattagttagttttgtttttaaactaatttgtcgaggtttagcaaacataatattatttttgaaatccctaaatacagctttggtgatttctggtgcttcattactaaatgaaagcaaaataaaatcaacttctagtttttctaaatgatcaatgtaaagacagtgactattgaatattaagttattacagtcttgatctgggaaaatatcaaattgttcacctttacgatcaattaaagtaaactttccttgtttacaaagattacatttgatttttttacaattaaaataatgatcacttattaagcagtgttttagatgcatattgattgttttgccatacactgtcattataatattttgtttaatattatttaaatgattaacttgttttctactcatctcgagagaaagaatagcatcatgattattaaaataattcaaagcatagctattataaaggttgaaagtactatctaaaatacattttttatctttaaaaatttgtaatgctccatagtcacctactaaaatactatttatcttattgtatgagacactatttttaaacttgattaaaatatcctgattattcaaaaagcttgtaaatgggattatttctttatttacagaatgcgctaaacttatagcttcatcaagttcttcgttgataggaaaataatatgcatccacttcctctgttaacaatgcttttaattgtgccaaattataaatttttaccacaatccctttaatttgtttattaatatgattatgtttagttttaatcattggttttttaactttttttatctttactatcatattagaaagttcatctattgcttgacgacgcatttcattaatttctttaatactaaaaaaaccattatcaggaaagtcaatagtaatatcatttgccttaaatactgtatttcctaattttcctaattgttgtctgattctttgaggatctaatggcaatttagctgctgattcaattagaagattagaaactttttcaacttttaaatctttatagttgatggttaatcgtgctggttcgttgatttgacctgaaaatgccatagttactgtatttttaatattttcatttttataacttgctaaagcttcattgattagatctatatcaataaccttatatactgtttcattcttttttactggggtattcaattcgatttcaacaatatcaccagcattgccttgattaatcaaattattaaataaatataactttgtaatagttcgagtaaacccaacactcttgaaattaatccgatctccttgtttcaacttatcttgtaattgaatttttacaatttttcgatgtttatcataatctatcactgtaccaacttcaattcctcggtttccaggataatctttagccacaaaattttgatcttttaaaatatatccaccagtgaatccacggttgaacatttgcttcattttttttatacgctgctcaaatgcattaactgtcgtattttttaaatatgcatctattgcttcacggtattgtttaacgattgtagcaacatactcaggtcgtttcatccgtccttctattttaaatgatgtaacaccagcatcaattaattgcccaatattctcaaaggtacataaatctttaggtgataataaatagcttggaattttatctaaattcatactatctttttgcaatttataagcgagccgacaaggctgtccacaagctcctttgtttccacttcttttagcaatcatactcgacattaaacactgtcccgaatatgacatacatagagcaccatgaacaaacacctcaatatctagaattgtgttttgacaaatatcagctatttcatcaagtgtattttcgcgcgctaaaacaacacgatcaacaccagcatcttcaaaatatttaactgctgacaaattataaatactagtctgtgttgacatatgaatttcaaaatctggaaagtattgtttaacaaaactcatcagtccgatatcttgaataattaaagcatcaacttttattgtttgtaaaaacaaaagataatcttgtagtttttcaaactgattatcttcatataaagtatttacagttacataaattttaacgttgcgtaaatggccatatgcaactgcagcttgtaattcctcgcgattaaagtttgttgcaaaagctctggcactaaattcatttcctcctaaataaattgcatttgcaccattttgaaccgctgctactaaagcttcataacttccagctggagcaagtaattctatattttgcatatgtattaatgctccgtttctgcaattaatgctatacacattttagctgacgcttgggatgctttttttaaatattcatcaaattggacagaagaatctcccttaccaaaaacatcacttaaagaacgtgtaataataaaactagtcccgaatttatagcatgtttgagcaattgctgctgcttccatttcagtacattttgcatcaggaaaattatttttaatgcgtgttgctacttccggtgtagcaacaaattggtcaccagaaacaattagaccaatttcgcaatttaaatttaagtttgataatattgttttagcttgagtaattagttgacgatctgcttctattcttgggggtaaacctggaacttcaccaatcactcgattgggaaatgccgtaatatcaaaatcatgttgacaaacttcattagaaataactatatccccaacttcttgagttaaacacagtccaccagcagaaccgatatttatgacataatctattttatagttagtcagtaataaagtagtacaaatagcagcattaacttttcctactccaccctgtaacaaaacgacttggcgctcttttatcgttccttgataaaatgtacaatcaagaatagagcgtgtttcagtaatctccatatattctttaattgctgccacttcttcttccattgctccgataattccaatcattctacttacctccccttcttttatgacatataaaaataattctttgtgatttatcatgatattcctcaaactcaccataatattgtacatccgtaaaacctgcctgtttcaataagctaagataaatttcaatatcgtaagtttgctgataatgcatttcttttatatgttcattattttccttatcaattatctcaatttcatgttccactttaccaagagcagtcttttctacatgccatttaaaatagaaatcatcagcatcttcttcttcaaaatagccatctagaatttcatccatcttataaagactatcaacatcaaatataaaggttccattatattttagtgattcatatacatttttaaaagttcttaatactttctttttactcaaaacataattaattgagtcacaaaggcataaaatcaaatctactgctttatcggttacaaaatcagtcatatcaactcgacctaataaaagattaacatctgcttccattgctttcaaacgtgaaacttcaagcatatctttagaaagatcagttgcataaatctctttacctgctttagctaaacgaattgcaatttcaccagttccacacccaagttcaagcacgcttttaaaatcagcgtgctcatttataaacttgaaataatcatcataaaattgttcatccattaagctgtcatagtaataagcaaaattttcgtatgacattaagctaaatattttgatacgtcaattcgtggcatatcagaccataatttctcaagattataactgtttcgttcgtcagcatcaaatatatgcacaacgatatcaccataatccatcaataaccacttgctattgcgtaacccttcaatttttttaacttcataaccattttcatgacagctgtcttcgacactgtcacgtaaagcattcatcaatctctcgttacttgctgaacaaatcacaaaagtatcaaaaataggactagctaactgcatgtcaattactacaatgtcctctgctaatttatcatctaatgcttttataattacttctaatttattcattaatatctccttttgcatatttattataaatttcaaaaaaacattcatcaatttttcgccctttttcatgggaaaaatcataaaaatcttgtaaacaccctttaaagccagcaactacatcttttttgcataatgcaattttttttgaagaatcgtaatctcgacttggatcgtatttatcagcttcataaatacacatatcaagttttgacatatataaagaagcagttgtatgatgcctaattgcttgtaatatttcaggatcatcaactaaatactcattttttgcaacatattcagataaccattgatgccaaaccgcctctggtttattaagataatctggataatttttttgcattattacaacagcttcatcatgaggcatttctttagcaatatcatgaagcattcctgctacatatgcttttctaccatctagattattagctaatgcaatttctttagctaaatgagccatgctcactgtatgacgatagcgttttaaagacattttatttttcacaattgtttctaaataaataccattattaacaatatattttaaaacttcaggatttaaagcatgtaatgcaccattccggatattattactagcgtcatcactggcaaccaaatctaagtgaataaaattatatttatctaaattatcattaatttgataacctatgcgatcgaataccactaattgagctaattgactcaattctttagcagcaatccatttatgatataaacttgcttgatccattcccatcataaaatataactgatcatttggatatattttttttagatatctaattgtatcgatcgtataattttttttactactatcttgatcaatctcgtagcggcaaatttcaacatttttatagcgctttaaagcaatttccaacatcgctaatcgttgttgtttagttgctcctgtagagtctttccatgggttgttagcagtcggcataactaaaattttatctaactttaattgcctgattgactcttcaatcacgcgtacatgagaacgatgaattgggtcaaaactaccgccaaaaacacctatttttatcatggtaatttataaatttccttttcacttgggcgatataaaataattgttcttcctaaaatttgcacaacatctgcttttgttttcatacttaactctagcgcaatctcattttttgaatcagcacatgattcaagaatttttactttgatcaattcatgagcttctagagcatcgtcaataccttcaatttgagtttgatgaactccttctttaccaatttgaaaaatagcatttaaattatgtgctatccctcttaaatatcttttttgctttcctgttaacataacccgattcctttctaaattaatgcttctctaataaaaacaccaacaccttgtggtgcatgaactctaacattggcattgggacaattaacactgacaaatcctagaccggaaataacaatatcaattttaccctctggtaatttaaaatcataacttgccatttcattaatatccttaatactttcaatttccggcatcagagtcaagtgccgattatataaattatcactgtttcccaatttagttctatgaatttttaataattttggaaaaaaacaagtaaaagaactacgcggtcctttaatgaaatcaacgcgtgccaacccaccaaaatatagtgtttgttggtcgtttaattgaaaattaattggtcttaattcgcttttaggaataattattctcaaatcttcatctttaactaaatgagccatctgatgattattaatgataccaggcgaatcatataaataatttttatcatctagtggaatttcaattaaatcaagcgttgttccaggaaattcacttgttgttattaaattatcagttactcctgcataatgttttaataaagaattaatcaacgaagatttcccgacattagtaactccaacaatataaacatctcgaccatgacgatattcattaatcttatctattaataaatctaaattataatttttggttccacttgataaaataacgtcaataggtttaattcctgattctttcaactgtcttcttagccaatgctcaattttacgatcttttagtgattttggcaaaatatctcgtttgtttccaagaactaaaatatcattattattaagatgccgtgataatccatttattaagctgccattataatcaaataaatcaactaaataaacaacaagacaatcatgatttccgatttcttgaagaatttttaaaaaatcatcactagtaagatctgttttttgtaattcatgataattttttaagcgaaaacagcgtttacaaagaattacatctttttctaaagcatttttaggcacaaaacctatctttttttcgtcttcactttgaattatggctccacagccaaaacatctaatctctttagtcatactatctccttttcaaaccactcccattgtaccttattttaagccaattttaaagtaaataatcgttaaaataaaacttggtataattttatttatttggatgaatataaagatttttgtcctaaattaaaagattgacaatatatatgtattagaggtgaaatataaatgttttcaacattattatccttacttactaatggtttctttgtctcatacattaaatcaaaatcttttgagttaccactaacagctaaagaggaagaaagatatcttgaacagttttttaatggtgacaaagaggctcggaatgttttaattgaaagaaatttaagattggtagctcatattgctaaaaaatacgagaacaataaagatatgcaggaagatctgatttcaattggaacaataggactgattaaagcagtcgatagttataaacaaaaccataaaactaagttagccacttatgcttccagatgtattgaaaatgagatattaatgcatcttagaactaataaaaagactaacttagatatttcattaaatgagacaatcggtattgataaggatggcagtgaaatagttttaggtgatatcattgccgcaaaacaagaggagtttatcgatatagtagataaaaaggatactttagataaatttacaacatattttagtgttcttgaaccccgcgaaaaagatactttgattatgcgttatggcttgaataataccaaaaagtatactcaaaaagatattgctaaaaaattaaatatctcacgttcttatgtttcacgtcttgaaaaacgtgcattaattaaattattgcgtgaacatatgaaagaaaaaccgtaaattatataatttacggtttaaaaatcatcttcttttagaatatcttctagagatattttttcatatttaattggttctgtttttttgggtactttaacaaccgctttatttttggtagtttcaacctcatcactttcaaaatcatctaataaggtatgctctttgggttgtttaaagatttctaaatcaacttcggttttcttagctacatcataatcgcttgttgaaattggagaatttatataaacatcatcaattacttgattagccgttaatttattagctacacttggtttttgctcaagattagcattattatagtcagttgctttaaattcaaatgaagtctgatcgtttaaagtgactgtaattaattgtgaattatcaacaattacggaatcttttacataaataattttagatttaggattcttatacaataaagttccttttgtagcacgattgcaaggtgttatatcgccaattttaattcgtttaaccccaccttcttcgctaataacgattaatgaactgctaactaatggattaaaaatattgagactaactaactcatcattttttaaatttacagctctaatcccagcggctttgattccaacgattgaaacttcttgctctgaatataatgctccatacccagctttagtcgttaagataattccttgattattatcagtcaatttaacatcgactacccgatcatcattctttaatcccatacatttaaggggctttgaatatcgagtaacttcaaaatcttttaaattcgtccgtttgatttgaccattttttgttgctagcataacgtacaatggtaaattaaaatcttttaccaaaatagttccgatgattttttcaccagcatttagttttactaaataactaacatgtttaccagcatctttccatttaaattcttcaatcttatgaactggaataaagagataatttccagcatcagtaaacagcaataaatgatctaacgtattggcttgatacattgaaactagatagtcattttcttttttgccgaacggaataccttcactagccttgatagaacgattactaattcgcttaatatatccatcacgggtaatagaaacattgatatcctcagataggatcattgctttctcatctattttaatttcttgaacctcatcacgaatttttgatagacgtggcattggatattttttcttaataccttttaattgatcaataataactttacgtagaacctcatcactgtttaaaatattatttaaatatgcaattcgattatctaattctttattttcattttccaatgtgacaatatcagtgtttgttaaacgatacaattgtaacattacaattgcttcagcttgtttttcgctaaaaccatatttttcaatcaagttatttttagcatcgcttttatcttttgattgtctaattgtttttacaacctcatctaaaattgaaattgctttaatcaatccttcaacgatatgtttacgctcattagccttattaagatcatgaattgaacttcgtgtaacaacatctatttgatgtgcaatatagccatctaaaatctcaattacccccattaagactggtcgcttatctttgattgcaaccatattatagttgtaatttttttgtagatcagtatttttgtatagatagttaagagtattttgtacatttatatccttttttaaatcaataacaatccgtaatccagtacgatcagattcatcacgaacttcgataattccatcgatattgcgattaaatcgaatttcatcaattttacgaactaattctgctttgtttacttcatagggaatttcagtaataacgattttattcatcgttttctcttcaatcatttcactagtactacgaacaatcactttcccacggccacttttaaaggcatttaaaattccttgttttccttcaacaatagctccagttggaaaatctggacctttaataaattccattagtttttccaaagaacagttagggtatttaattcgatgaatcgttgcatcgattacttcttcaagattatgtggaggaatatctgttgcataaccggccgatattcccgttgcaccatttactaataaatttggataggccgctggtaatacagttggttcatattctgtatcatcaaagtttaaagacattaatactgtatctttatctaaatcttttagtaattcaacagcaattgctgatagacgagcttcagtataacgcattgctgctgccggatcgttatcaatagatccattatttccttgcatatcaactaatggaacacgcattttccaatcttgggataaacggaccattgcatcatatactgatgtgtctccatgaggatgataattaccaataacgttcccaactgtttttgctgacttacgatatggttttgaatataaatttccttctttatacatcgaataaagaatccggcgctgtactggttttaaaccatcacgaacatcaggtaaagcacgatcttgaataatatatttagaatattttccaaagcggtcacccatgatagtttctaatgacataattatttttttatccacgcttattttctccttactcaattgcaaaattatcttctaatgtaaattggacattttgttcaatccattctcgtcttggttctactttatcacccattaatacagaaactcgacgttcaacaattgccgcatcttcaattgatacttgaattaaagtccgagtttctggattcatagttgtttcccataattgagaagcattcatctccccaagtcctttataccgttgtacattatatccacgaccaattttcttctttgcttcttctaattcgtcttcttcccaagcgtaaacgatatcttcctttttcccacttttctttgacactttataaagtggtggtaaagcaatatatacttttcctgcagtaattagatctcgcatatatcgatagaagaaagttagtaaaagaatttgaatatgggcaccgtcggtatcagcatcggtcatgatgattactttattataattactatctttttcgttaaaatcagctccaacgccagccccaattgtattaataattgttgcaatttcttcattttttaaaatgtcagccattgctgccttttcagtattaacaacttttcctcgtaatggtaaaattgcttgatatttacgatcgcgaccttgttttgcactaccgcctgctgaatctccttcgactaagtatagctctttacgttttttatctttagattgagcaggtgctaattttccacttaaaattttttcttgacgtgggcctttacctttacgagcagcttctcgagctttacgtgccgcatcacgaacttgagcagctttaatcattttcttaacaagattatctgctgtttctttatgctcttctaaaaaatatgtaagtttttcataaactactgtatctacaacatttcgtgcctctggcgttcctagtttagattttgtttgtccttcaaactgtaaataatgttcaggtactttaattgaaataattgccgaaagtccttcacgaacatcatttccttctaaattcttgtctttcttttaataacccatatttacgagcatattcattaaacgttctagttaaagctgatctaaatcctgtttcatgagttccaccatcaccagttctaactaaattcacaaaagataaagtagtttcttgataaccactagtgaactgcatagcgacatcaacttctatttcattatttgtaccctcaatattaataatttcattaagagtctctttttcataatttaaatattcaacaaatgctgttaaaccattatcgtattgataacttatctctttacctgtacgttcatcaactaaatcaattttgattccttttaaaaggaacgcactttccatcaatcgttcactaatcgtagaaaaattatattcataaactgaaaaaatgcttgaatcgggcataaaatgaatcgttgttccagtttgatttgatttaccaatcacttttaacttcccaactttactaccaccatcttcaaatctttgctgccaaatttttccatcacgataaattgttacttcaagccatgaagatagtgcattaacgaccgacgccccaactccatgtaatccgccagaagttttataaccgccgtcttcgttaaacttaccgccggcatgtaaaatcgtaaggattacttctgttgtaggcttacctgaagcatgcatccctgtcggcattccccgaccatggtcagttactttgatactgttatccttacaaatcgttacttgtatattatcaccaaatcctgaaagtgcttcatcaattgcattatcaacaatttcccaaactaagtgatgcagtccgcgtgcatcagtcgaaccaatatacattcctggtcgcttacgaactgcttctaagccttcaagtatttgaatatttgactcatcataattacttttagctgccatataattcatctgcctcctttaatcacttgtaccattatacctaaattttaggttttttcaaagattattgcatttttataatgataatatataatagtcacaggtgataaaaaatggatataatgatttcaataattttaattatactcagttatctatatggatcgattccctttgcattagttattgggcgattagtctataaaactgatgttagaaactatggttccggtaatttagggggaacaaatactggtcgtgttttaggaaaaaaagctggtgttgctgtaattcttttggatgcttcaaaggcattattagtaatgcttttaactagttacttatgttcactattaaaaatgaataatgatttagcatatatatgtgctttagcttgtgtgattgggcactgctatcctgtttttgcaaatttcaaaggcggtaaagcagtttcaactgcaatcggtttttttatggctgtcaatcctataggtgctgtcttagccttagtcgttttcttcattgttctaaagctttctaaatatgtttcactgtcttcagttttagcatcgtcttcagtattgtttgcaattccgtttttaaatatgtcaatgactggtaaaatcgtaactgcagcggttattttactgttaatttatcgacacaaagaaaatttaattagaattaaaaatgggacagaaaataaaattacttggatgtaaatatgctcgttaatacataaagttgtgaattatcacggcttttttatttaataaaaataaggatgcattatccaaaaagagatgcatccattaggtaattatttatatgtaattatttcactactttttagatgactatcatcaccaatatatttaatcttaaattcttttccatcatattcaacttcacttaaagaacaaccacgaacaacatatttattgatttttgttaattcggatgttttataattaagcattattccgtgaagaataataaataacatcccatgaatcgtaataaaaattgtatcatcatgatgttttttataaatatcattaaaaaaatcttttaaccgcatttggacttcatgatatgtttcaccaccaggagtgctaacatcatcatccggaagattccataatcgattataaattggatcatttaataattcattaataaggcatccttcgtatttaccaaaattcatttcttttaatcgtttgtcaacaagaaaatgatcaaataatatttcacttgttgctttagcacgttctatcggactgctataacaataatcaattttaagttctgtgattcttgcttttagcaacttagcatcttctatgccttctgctgttagcggtgaatcttgccatccctgtaatcttttttcttgattccacaatgtttttgagtgtcgagtaaggtatattttcataaagtaaaaataagggttaccccttatttatattgtgacataacagatgacatgatttttttaatttgagcctcactaggtttacgacccatttccatatacattgcacgaatcattttttcgttgattggtggatttttttgtaattgttttttaaacatataacgtgctgcgaaaaaaccgataatcgcaccaacgattaaacccaaaattatattcaacatatttatacctccaagtttttagattgctctaccattataacataactttttgatatttggtataaaatatccaagaatatatttgtttttttatttgcttcaataattatatagtaatcatgaataacgcaaatcatttcttcttttgttaattgattatcaataacatgtttatttttatcccgatgataatcgtatcggtcttttaacttgtattcgataaagtcactaactccttcattatttccaaataaacactccatttgcttcgtaaaaaaaacatttttaggttcaatattaatgatttgatttttcacctctggatattgttcaagtaatccaacaacattaggatttaacttatatattttatatgtattcatttctatcaccatgattagtgtatcaaagaaaatctaagtatattgtcaaatcatgcccaaaaatcaataaaagtgatgttattacatcacttttactagtccttataaaatatctttaacgttttttactacattttcaactgtaaaaccatagtttttaataacgatatcagcaggtgcactagcaccaaatttatttactgacattgttttaccatctaaaccaacatatttatgccaaccaaaatcactggccatttcaattgataaacgagctctaacattgtgtggaagaatctcatctttatatttagcatcttgctgttcaaataactccattgatggcattgatacaacacgaacatcgatatcttctttcaataattcttctttagctgccattgctaaatttacttcactacctgaagcgataataattgcatctaatttattgacttctttacctacaatgtaggctccatgacaaacaccttcgtatgaagttgcagtcattgtggtaacattttgacgagtcaaaattagagctgtaggattattagttgattcaactgctaatttccatgcagatgccatttcgacagcatctgctggtctaaatactcgcatatttggcattgaacgtaacattgttagttgttcaacgggttgatgagttggtccatcttccccaactgcaatcgagtcatgagataatggtaaaatgattggcaattccatcaaacaagccattctcaaagcgcctttaaagtagtcagagaaaactaggaaaccacctgcagatacttttattcctgtgtgtaaagtgattccattcatcattgcaaccatagcaaactcacgaattccaaacgctaaattacggccatcataattttcaacactaaatgttttttcgcctgcaatatttgttttagttgaagatgctaaatcagctgttcctgacataaatgtaggattttgttgagcaacttcttgaatcatttctaatgaagtgtttcttgttgcatcgttatgaccaggtgaatattttttcattatttcatctaaatctaatgaaaagttcccagcaatagcattttctaattcttgagcaagttctggataagcatttctatagtctttcattaaccgctgccacttattataacgattttttccacgtttaatacatgtattagcaaaatcatcataaacttcttcaggaacataaaattcgtcatgatcaaagccataagaaattttagcatttttaccatcttcttttcctaatggattaccatgaactttattagttccttcattacttgaaccaaaaccaatcactgtatcaataatgatcaaagttggtttatataattcttttttccctttacggattgctttttgaattgcactaacatcatttccatctgttacacgaattacttgccatccgattgcttcataacgctttttcacatcttcactaaaagacattgataacggcccatcaagcgtaactttattggcatcatataaaacaattaatttacctaacgataaatgcccagctaaagaagcagcctcataagtaacgccttcttgcatatcaccatctccgcataatgcatatgtatagtgatcgacaacatcataaccctcacggttatattttgaagctaagaatttttctgctaaagccattcctgctgccattggaattccttgacccaaaggtcctgaagaagcatcgacaccatcagtaatatcacattcaggatgtcctggagtaatagaaccccattgtctaaaattctttaagtcatcaatagaaatttgataaccagataaatgcagcattgaatataacaatgctgaagcatgaccagaagccaatacaaaacgatcgcgattaaaccattttgattgtttgtgataaaaatccatttccttagtaaataacgtatagattgccggtgttgaccctaataccatccctggatgaccagagttagctttgttgatggtatcaatacctaacgcacgaattgttgcgattgataagcttgatgtttccattaatttctaattctccttttttgcacataaaaacttattcttattatacacaaaatcgtataaattaaaataagtttttcgacaaattatattaattttttaatttttcatcttttagcttttgtggcgtgatatcatttccttcttcgtcaacaactttaacacccattaattgttgcttaaacccactacgaaaagcttttaaatatttttgacgtaattctttttgttcttctaattcagcctcactgattgtaccatcttttttctttttagccaattcattaattcttacaattaattctggatctatattactcattttaattttctccttaaatataaaaaaggtagagagctttagatatttccctgttaagtacaggtgggcacctttaaatatactttaggatccctattcaaagacaggttttcaacaccgcaatttagatcaggttcccttatctatgatgtggaaatttatttactctctaaccaaaattattataacacagccaccttaagtgtcaacactttaagcatagcgatatgtgacaaaattattactttttcttaacaatacaagtactagtgtattcaatatcaaaatatttaaaagtgttataaatatctttaagttgaatatcagccacctcatcgactaaattcaaagcgatagttccttcaaaataatagcgactgaataaattcgcaatactttcaggactattaaataaatttataaataatccaatatttttctttttaattctttcaaagtctttttcttcaatcttaagctctttaaaatttttaattaagtcgagcaaatgattttttaatgtttcatagtcatcacaatcacatccaatttgaataaatgcatagtctctttcttgcgtaaaacttgcactaaatgaatcgttaataatccctttatttaaccagtcgttatataattttgaactttttgaaaatagtaagtcaaacaatagattcattgataactcacgtttgattttttctttaggttcagaaagaatttcatttattttaattgaaacaattattttattcatttcaacatccattgataaaatattttcttttgttttaaccttacaaggttcaatgtttttctggcaaataattggttgtgctgtttcaaaattctttttagcctgattttctctaattacatttatggctgtatcggcattaatattacctacgacaaataacatcatattactaggatgatagaaagtattatagcaagtttccaacattgttttatcagtgcgatttacggtttcaactgttcccgcaatatcaatggctacaggatgattattgtaaaggttttgaattgatccaaaataaacacgccaatctgggtcatcatcatacatttttatctcttgaccaataatccctttttccttctcaacgctttcaggagtaatatctaatctttgaacaaaatctaatagtaactcaatacatggatattcatttgaagtagtactaaataaataggctgttctacttgatgaagtgaaggcattggtactggcacctaatttagcaaactcatcagaagcatcagtaccattcatatcaaacattttatgttctaagaaatgagctattccgtcttctactttaatcatttcattaccatttaaaggtacaaaagttgtatcaatagcgccgaatttggttgaaaacaacccgtaagttttttcaaacccttgttttggtaaaagataaacttctaatccgttatccattttttcatgatataaagtttcttttaaagtatcaaagtatattttttccattatttatcactccctgttaataagaaaattgtatctaagtgtacttttttgctggcagcaataatttcttctttggatacacgcattaatttttctaaatattcatcatttgtttcttgaacacctgttaaatcccggttataagccaatgtaatcaaactaattggttcatctttagtttttgttaatgagctttttaacatcagttttgctaaatcaatttcatcattactaaaatcaccattttgaatattctttaattcttgggcaattaagtccttagctttttgatagtcactgccttcaattcccgcattaactgtcataatcccactaaatgccccatagcttgatgatatatagtaacataaactatgcttttcacggacaattttgaataaccgtgattgtgaaaatccgccaaaaattgcattaaatacagtcatcgcataagtgccaggatccttaaagttacaatcaacaacatatcccatatttaatttagcttgagtaatatcttgtttttcaactacttctaagatgtcattcttgcttgatttgaaattagtaactggatcaagcggttgactgctgctgctaaaacttagattttctttaaatacatctacaatactttcatcaacatcaccaacaacatataaatgtttaacatcattctctaagcattcaactaagtatttatagacctcttcattagtgattcgatcaagttcttctacatagccattattactaatggataaaaaaccaccctcacccatatttttgaataattgatctaatccgtacataaatttatcatcattttgaacaatcaaacgctcttttaattcttttttcttaatagcaaaagtttgttcatcaaattttccatttctaacattgggatgaaataaaacgtcattaaacattttgatttgttgcactaataaattttcttgatacggcaaaaatgtttcattaatacaaacacttgaaatatttaacacttgtccaattcccttagtcgctaaattagtgccaaaactcattccataaagatcttccaaatgagttgataatgcttgagttgagggatagttttctgttcctccagtaagcataaaagccaataaagaacgtttagtaacattttcttttgttaactttccttctaattttaatgacattgttatattcttaaattttttgcttggaataacatgtagtgtatatccagctaattgataactttttttcataaaaatctcctttacaaacctaatgtatatattatacactaaaaaataaaaattaaaaccgcatcttaaaaagaacaagttaaaaagaacatcatgatgatgttctttttaacaaattaacgttttgctttatcaaaaggttctccagcagcttttggtgctgcagaattttttgaagtaaaagctaataatattaaagtggcaacataagggaagattttaaaaactacacctggaactccagaatttaataaaaatggaattgaagcatatgttacagctaaagtcttagcaaaagcaaagaaaattgctgacaatgcgattcgccaaggtgtccagttaccaaaaattaaaactgctaatgctaagaatccatatccagcaactgtactagaatactcacttgttattgggattacatagattaaaccacccataccagccaatattccagatagaacaacgcctaaataacgcattttatatacatttactccagcagcatcagcagcttgtgggttctcaccacatgtcctaattcttaatcctgttttcgttttatagagatacacgtatgtagcaatcaaaatagcaataccaataaatgtagaaagataaaaatctttaaaaaacatatcaccaattattggaatgtctgaaagaactggaactttttttattaaaaattcattactgaacggaatacttttcactccaccaaaaatagtcttagcaacaaaaattccaaaagcaggagcaaataaattcaatgcagtcccagaaatagtctgatcagctttcatactgattgcagcaaaagcatgtaacagcgcaaataatccaccgattactccagaaattaataaagctactagaaacaatgcttgcccacttaaccagccggcattttgagcagtatgcataaaccaaatcccaaaaaaagctccaaaaatcataattccttctaaggcaatattaactactccagagcgttcactaaacaacccgcctaaagcaacgatcaacagagggatcgaaaacatcaagctttgtctaaataagaaataaaataaatccattattcatcccctccaatcaaagcttgttttttatcttttttacgcccctttcggcgttctaaaattaatcgaataaacaatgtgaaagaactaaaataaataattgctgcaacaattacatcgataatttctactgcaatatgtactgcttgaacatagtttccgcctaaattgatatatgcgataaataatgcagcgaaaatcacgccaagtggattgttaaaccctaataaggcaacaggaataccattaaaaccttcagcggctaaaacttctgctgttcctattgttcgtccagttcccgccatataaaccaaagctccacctagtcctgcaaaaaaaccggcaattaccatcgataaaacaatactttttttctcattcattcccgcgtatttactcgcatctggattatatccagttgcttttagttcataaccaaatgttgttttattcataataacataagcaagaatacatacaccaatagcaatgaacgttcctaaattaatgctcgaaccattaaaaacctgatctaatcctaaatttggtattgctaaacttgtaggaatagtatacgattcagcgccagtgggattatacataaatttttttactccttcaattactaatagcatcccaatataattcatcatgatactagatattacaacattaacattgcgataagctttaagtaatccaggaacactggcccataaggctcctgctaatcctcctgcaagcacagcaaagatccaacgaatagattcggggataaaagttgcattaaaagctataaacattgaagcaaaggctcctacaatatattgtcctggtgttccaatattaaatagaccacatttaaatgcaaaagccactgaaagaccggtcatcataattggtactgataaatataatacttcaccaacgcttttaattccacgataaaaaccacctcgaagtaagattgaaaatccttctaatgcctgattaggaattactaaaaacataattagtagtccaaaaatcaaaccgcataaaatcgcaatcaaagaagataaaaatgattttgtccatgctttatttttcatatccaacacctcgctttgatcccgccatatacaatcctaattcttcaacgttagtttcttttggatttaagtcagtaacaatctctccttcatacattaccagaattcgatcactgacattcataacttcatcaagttctaaactaattagtaaaaccgcatgtccctcatcgcgctgttgaatcaactgtttatgaataaattctattgctccaacatcaagcccacgagtaggttgaacagcaatcaataaatcacaattactttcaatttctcgcgcaataattgctttttgttgatttccaccagacattcctcgaacaatcgaatgtgacccttgaccagaacgaacatcaaatttttcaatcaatctatctgcataattataaatgttctcaaattttaagaaaccatgtttctggttatctttattaaaataattttttaaaatcatattttctgctaaattataatctagtactagtccatgcttatgacgatcttcaggaatatgggaaattccttttaaatttctttgcctaaccgaataatgggttatatcctcattatttaaaattatcttacctgtatatccagttaacattccagttaatgcatatacaagttcactttgcccgtttccatcaattcctgcaatacagactatttcaccacgtttaacttcaaaattaatatctgtcaaggcatttttcatagcgtttttcttacaataattgagattttcaacctttaaaaccgtttgcccaggagttgcttttcctttttcaacaataaaattaacatcacggcctaccatcatctttgacaattcttcttttgaggtcgttgtaacatcaacagtagcaacgtactttccttttctaataacagtacatcgatcagctaccgctttgatttcatttaatttatgtgtaataaaaataattgattttccttcggcaactaatcctttcataattttcaataattcttcaatttcttgaggggttaaaactgcagttggttcatcaaatattaaaatctcattatccctaaagagcatttttaaaatttcaactcgctgttgcatccctactgttatatcttttataagagcatcaggctcgatatttaaatgatattgtttggaaagatcaagaacctttttacgagcattgtctttggctaataatccatttttagtttcttcaacacccaaaataatattatccaaaactgtaaatgtttcgactaatttaaaatgttgatgaaccattccaattttataacgattagcatcgttaggatcatttatttcagcaatttcaccgttaattttaatgcatccctcgtcaggttgatacagcccgaataggattgacatcaatgttgattttcctgctccattttctcctaacaaagcatgaatctcacctttttttagttgtacggttatattatcattagccttaattccaggaaattctttagtgatattcaacatctctattacatattccataccgtcactcctttcttatctaatgttgatttttctcggttagattgagaaatacttttaaaaaaagcgagttgtctcgctttttattatttatcatatgtaatatttacattagtgacaggtactttagtaggattaccattatcattgtcagtaatatctgtcattgatttgattttaatttcaccacttgccactttatcaaatacttccttgtatgctgcagcattaaaatcacccaaacgatcaaagtcatctggtaaaccaacataaccacctgatgcatctaatgtttcgataccacctttaaatttatcatttttgtaatcgactaatttatcataaactgtcttttttacatcttttaatgctgaagtaataacaacacctgtcttgtcatcattttggttgctatcaacaccaattgcatatttgccagcttcttttgctgcagggaaaatagagttacaaattccaccaccgcatgagaaaatagcttcagttccagcatcataccacttagcagctttagttttaatcgcaggatcttcattaaatgttcctgtatatgtatacatcatatcgactgtaacacctaattcttttgctgcatcatttgctccttgaatatatccataaccataattaattacagctggtaatgcaattccacccataaatccaagtttagtgtgacctgctttgacagctgcataccctgctaaatatccaggttgtgtttctgtatacaatgcacaataaacattatcaccaggatcaactggattagatttagtactatccttctcatctggaactgttggtgtagcatcaatcaagataaatttgacatctttgtatttatcttgtaattcaccaattgcattacagaatttaaaacctggacaaacaataatttttgccccattttctacagcttcttcaatttgtgatttgtagccagcatcatcaaaacttgctggtttatagtatttgatagttgcatcatgatctttttgatactgttcaacagcttcccatgcagactgattaaacgatttatcgttaatatcccctgcatctgttacaagtgctacttcaaattcttcactgctactaccaccgcatcccactaatagaaatgagaatacaacaagtgaagccaaaagctttttcatattcaattttcctccttcaataaactatagctttattttaacattcttccttaaaaattgaaagcgattacatttattattcccgtttttttataaaatatacaaaaaaagacatctatttagatgtcctcttcttgatatccgcgaatgtaaacttcacgtggcttagagccaatctgtggtccaataacaccgtctgcttctaactgatcgatgattcgtgctgctttattgtatccaattcgaaactgccgttgtaataaagatgtacttgctttttgagcattgattacaaaactgcgacacatttcatattcttcatcttcctcttcttctttcgaagcagcacttggtgaagtagtatttaattttacatttatgtatttgtcatcatagctagcctcctgctgagtagcagtgtggtgagtaattgcactaacttcatcgtcagatacaaaagcaccttgaacccgcaccggtgaactagaacccattggtgaaaataacatatctccttttcctaataatttttccgctccagaagcatccaaaattgttcgtgaatcaattccagaagagactgcaaaagcaattcttgatggaatatttgctttgatgactccagtgataatatcagtcgatggtctttgtgttgcaacgatcaaatgaatccctgctgcccgcgccatttgagcaatcctcatgatacaatcttcaacttgtttgcttgcgaccatcatcaaatcagcaacctcatctaaaataactacatgaaaaggtaagatctctaattgttcgtccaaagctaattcttcattttttttacgtgcatagttattatagccttcgatattccgtacatttgccccagcaaaaaggtcatagcgatgctccatttccactacaacttcctgcaatactgcagctgcctttttaggatcagttactactggagctaatagatgaggtataccattataattagttaactctacttttttaggatcgacaagaataaatttcacctcatccggtcgagcacgcatcaaaatactacaaataatagtatttacacaaactgattttccacttccagttgccccagcaatcaataagtggggcattttatttaattccgcataaataatcttaccactaacatccttgcctaaaggaactaacaacttgttatcctgtaaatcttttggaatgtctttaattacttctttgaaacttaccattgttgcaacactattaggaatttccactccaactgccggtttaccaggaattggtgcttcaatacgaatatcttttgcagctaaggctaattttatatcatcttgtaattgcataattttattaacacgcgtgcccgtttccaattttaattcatatttagtaaccgatggtccaataaaaatatcactaattgttgcgtttactccaaattcatgaagaacatttgttagtgcttcagctttagataatgcatttcctttattatcaccagacttttttgctgtaggattttttaatagggataaggcaggtaaacgataattcttattaatctttttcttaggtttagacatatcattttcatggatctttggttctttatctttaatttctaaagtcatagaatcctcatcaaattcaaatgtagagggtactgattcatcttcttctaaatgagtagtatggattcgagctgaactctttccagggggatcttgctcttggcttgaagtattttcatcaccaaatatctcctctggaaaaaagccttttgctttatcttttttaggggtaaaaaaatctgtgaatttactagcgctttgatgcattttaatatcttttttagtgggtttctttttctttctttcagcaacatttttacgatgttctaaataaaacttactacctaacaaagttaaaccaattactaaaataaaaccagcagcaatcattgcccccgttttatcaaacaaagcacttaaaatgccatataaaacagctcctagaaatccacctcgattacaaggtgctgttgagacatattgattaattactttcattccaaccattaaatcatcatttaaagatgacataaaagtcaaaactgcccctaccaccatgtataatccgattgcacgaggaccagtaaattttggtaatttagcaaaataaattacatacccactaatcaaaaccaatgaaatataactaattccaacaaaatttccaattatataagtacacaaaaaattcagttgttcaccaattggtcctaatttcattgccccgacaacaattaaaaacaagcctactgtagcaatgattcttacttttaaatcctcactaatttgatcttgttttgatttttttgaacgacttgttttcgccatgactcacactcccaactctaactcaatcattataccatatcatatctatttagcaaaagaaaaagcaaggataaacttgcttaaacttcgatgataattggcaagattacaggtcttttacctgtctctttaataataaacttatttgctttatctttaatattttgtcgaacttctactgcttctagtttaggatcatctttcatttcactaacacatttttcagcaatatcaataactcccttaataatatgttcagaatcccttaaataaacaaaaccacgtgactgaacatcagtattggcaataatttcatgagttttactatcaatcgtgactccaataatgactactccatcatttgacaactgaattcgatcatcaataactttatcacctacatcaccaacaccaattccatcaatcattacatcttcaacttcaatagtatcgcgataatcttctagttttccacttttaaacgataaaatttcaccattatcgataatagcaatattttctggtttaattgccatatttttagcaacttccaaatttgaaataaaatgttgatactcacccttaactggtacaaaatatgtcggattaaaaatttgtataattactttaatatcttcctgcgatgcatgcatcgaacataattctttattttttaatacatgaatatttgaatctgtcttatataattcatttaccgctttatttgcaattttttctgttccaggaataactggagaagcaacaataaatgtatcatttttatttaattttaaaaactcatctccaccatcaatgatatcacaaatatcatgatagattctttgcggtgtcccactgagcaacactactaaattatcatcaattccttttttaccaatatcagtagaaaaagcaataagattttttggtacttgaatcactgctttttttaaacgctgtccaatgcggacaatactatttgtgctatcatatttatcacgaccataaaaaacaatttttcgattatatttcttcgtcagttcaacaatttctttagttctaaaaatgttttgagcataacttgaaataatgattcgtccttcactatcttcaaaatattatcaattttatctgtcaatttatgttttggtgatgtataacctggatttttagaataagatgactcacataaaagtgctaatacacctttttttccaatctccatcattttttgaatatcacatctaaatccttctggggcaccaaaatcaacaataaattcaccgctataaacgatatatccattatcagtccataaagccactccaacactaccaggaatcgaatgagttactggaaaaaattcaacaggaatgccagcaataataattgaatcattgcgttttacacgatttaactgataactcactctaaaattattatgttttttatgtcgcttgatcatttgttcaattagatcagctgttagtgctggagcataaactggggcattgaccgcttctaacaagtaaggcaaagctgccatcacatcatcatgaccatgcgttatgatgatagctacaactcgttctttattttcttttaagtaatcaaaactaggaataatgatatccactcctaatttacttacttctgggaatctaaacccggcatctaaaataaaaatctgttcttttatttcgatgcagtacatacttttacccatctcagcctgtccgccaagtggtaaaattttaacaacatctttcttcattttttcctccattattataatctatattatttcttaatcatcgctgaaaaacaatctttaccatattaacatattatagtatcgtttgctaatactttctacgttcattgtatcaaaattctcaagaaaagagaaatgatttaatttttactaacatctttaacatgtaatattattaacacaataaccttttttagccgtgttcatttaagaaattatttagcaaaagtgagatcgtaaatttcatcttgttctggtaaatgcgtaacatacccaattggtattttattttccgtcacttcaattatagttttagctcctgcttttccaaaagcaccgcataattcgatgcagtcaactccctcaataaataattttttgccacaatacttgcttctgctaaattagtaacgccaattatttgtgctgtctgttgatggattgcggcatgatcatatttcaaattaaaatctcccatgattataaatgcaaatttcattatattgtctccttaaaattcaaactctaatctttaattagactttacgagtatctactttttcatagttatctagccgtttttaatagtatataacatccgcctcattaaataaataaatttaaagtatctttttttatttcgtgattcaaaaataatggagaaataaattaatatttctccattattttattcaattgttcttttgactcatcactgattttaactaatggcaaacgtaacttataaagaatattgctactttggctcaacgaatattttaatgtacttacaatattatcttgataaaaatatttaactattaatttaaaaaaatcaaaatataaatcattatgctgagtaattaattctctatactttttataacttagattagttaagttactaataagtccatcataattattaatttcattttgcactagcatctcttctataccgtatagacctaacccgttatttctaataatctgataacctgtgctatttacttcagtaatcaagccagttatattttcatgtttttctttcaattccaataaatgattaacagcaatcatattttgcttatgttgttgaataacaatcgatttattagttgcagtagcaattagatcaagatgcctaatcaatccgttttgggttaaactaaaaatttctggtaactcgatcatatagccagcaaattcgctaatgtctttaaggtctcctatctgtttaattactttttttgtacatgattcactaagctgcatatatatttcaagaccaggatagtgatagcaaacatatcgtaataagtgtttttgttctaaaaaagtcaatgaagcagcttcccctgtcctgctgccaataataaatttattatttccttgatttactaatttttcaatatgattatctagcgcttgataatcaatcatatcatcaatatcaaagggagtaattaaattagtaaaaatatctattttaatcactccttacaaccaaatcatgtaaaagattcaaatcttgtttttgattttttgctttcacataataactatcatgttcatttttagaaacaattgcaaatttttcaagaaaattccgataaatctcatcattttctaatccacaaccaacaaaatgtacttttgtataaagatctattttagtataatcagtttctagtttagctaaatcttcttcaaaaattaaataatcatcgtcaaagcaatcatgaaggaaactataatcgcttttagctattgtttcttcaaaacgaattagccaataattaaaatcaattgacattgttcggatatttgtatcatcatgattaatcaaagtaccaatcctatcatctttaaaagaacgtaacttgattttaaagccatcttttttatacccttccatcaatgctttgtaacaaatgatccgagctttgtgcttggctaaatcaagagcttgacgatagccaatatgcttgataagtcgtgcttcattaatatatttaggatcaccagtaaaaatgccacaaacatcactataaatatatacctcatccaaattcaaacgtcgtgctaggtatactgctgtataatcgctatcccctttttctagaatacgaatatttttaaatttatctattccctgaaatcctggcacgataatgacatcatatgtttcaaaatacttattgattactttggtatctaagccaactaaacgattatgcttaactttaagatttaactgcatacttgaaagcgagattgcattaattccttgtgatttcaaattactagataacacgatactacttattatttctccacaactaagcaatcgacaatgttcatcgtagttagcattaagtgctagtgcatttaatgtatcagtggcataagcatctggataacgtcccatagcacttacaataactaataatttatgatccaaattattaattataacattagtaactagtttgattgaatcatttgtttttaaagcagttccaccaaattttaaaactctaatcatcttttacaccctcaaaaacgggctggagctgattattattaattgcattgattactgtttgaattacaagagtctcatcaaataacatgctatttggtttttttatgcagtcatcttgatacattgggacaagataaaaatgtttagtatttaaaatttgcatgatatttttaccagaattacttaaagcatcgtttgtcgcgattgctaaaacaacattatgttcattacgaagtgttgatttacaagccattgtgacagcattatcgtttatccctatagctaattttgctaatgtgttgccactacagggcattacaatcattagatccaaaggaattttgggtccaaatatttcactgtctacaacattagtaattacttttcttttagaaagtttttctaattcatcaattaattcgtcagctttattaaaacgagtattacaatttaaaattttttcacttgcaaatatatataaatcacattctaaagctgctaattcttttattacagccagcgtcttttgtagcgaacaaaaagaccctgttaatccaattccgattttcttgtttttaagcatattgatcaactgcccgtttaattgctttataaagcgcttttgcactactatcataggcatacttagtcggaagctgctttaatagatgataactttcatcacgatcacaagtttttaaaccatatggtgttgaagcaacatcataaatcttacaattaacatcttttgtttttagaatatcgctgtcaattatttgactaggaatagtattaataacaaaatcatacccatttaaagtgagctgatccaaccgaatataacgatatcctttttcaacaacttcatcatgataatgatcactgcgattactaatgctgactttcgcattaaatttttcaagtttagctgctaaatcgcgtccacaatgaccataacctaagattaacacattagaatttgacaaactaattgaattatcaattatcatatacgcaatcactgcttcatcactaatatgtgtattttcaacaacaaagtcttcatcactatacaagtaacgataattaaatccctttaacttacttaaataacataatcgctgattctttaataatgaaagtactatagcattatttttaaaatcaacttgttcaaacccctgaccatctttacctaaataaataatatcacaagaagatatcagcctactatcttcttgaatttgataaccatctgcaatcattagctttgctaattgtttacaacgattatcatttccatttatataaactatcatattccacctctactataaaatatgataattaatttagtttgttactcgataatcactttcatcatgaaagtaattcaaaacccatttcttcagttaataaggctaatataatttcaatacgttcttgtaaattttctactgcttcatttaaaatctctttttcagacatttctgttgagaaatcaatcaagacaaaagaacacttaataacatataaatgcccactgttttgcttacctacagatatatgataattaagctgcaatcgatttttttcatcgtgactatatccaatttctatctgtgctcgaacatccgtggcacttgctgatacggtttcattaataatgtttgcatgaatacttttcattttgattttcattttaaaatcctcctataatattatttactattcaatgttcattttttcttttattatttacaattttttagaattttattaaaataacattattgggggttgaaaaatgtatctatttatgtttataatcacctttttaatgtcgttaaaaacctcttgggcatataataattttacttacttatcttatcaacctcatttaagaatatattatttaatttgggttacattaatttcatgtttcttattatttaaggtaattaaactttttaaacatattacgtatctaacgattgcaaataagttcttaatcgggagttgttttatttccatgctgacaggttcctatttaccttatcatcctgataatgaaaatattgtttcggttctccatgtcctcatttcatcatcaggaaccatctccctattatttattatccaattactaattaatcgtatcatgttagatgattatcagttttataaaaaaatgtctactctatttaggagtttagtcttattaattggaatgtttatcattatgtttggcgtaatcaatagtattgttgaacttttctttacttttactgtgttgttttcacttgctcaaattgaaaagcactatttttaaataaattaagcataataaaaagtaggtatacttaaagaaattttatctttttatatacctacttttattgctttaatttaaaaaattattcttaattatccgaaatagcgttttaataatccagcaaacgcttttccatgacgtgcttcatcacgtgccatttcatgcactgtatcatgaattgcatctaagtttaatgctttagctttcttagctaattctgttttacccatagttgctccattttcagcttcaacacgcatctctaggttcttttttgttgaatcagttactacttctcctaataattctgcaaattttgctgcatgttcagcttcttcataagctgctttttcccaatataatccaatttctggatatccttcacgatgtgcaactcttgccattgctaaatacattcctacttctgagcattctccttcaaagtttgctcttaattcttttttgatctcttcatctacgtctttagcaacacctacaacgtgttctgctgcccaagtcatttcacctgtttgttcaacgaacttgtcagccccaactttacatactggacattgttctggagctgcatctccttcataaacatatccacatacagaacatacaaatttagccattataattatctcctttttatattatttatttcatcatcacctataattaacagtaatgattactgatattaatatatcatattttaattttttgtcaatatatatactcacctaaatagaaaaaaagctgaatttttattcagccttcttctaaaagagagagagaaatatatcgctattaacaattttcttttttacggtatagccataatccagcaatacttaacattcctaatactaagaatgatccaataactacatcgtcaccagtttttgaactagttgttgtatctgatgcagtgtttccattaattataccatcttcattaggggtaactgatggttttatttctaatgcatcaattgctgcttgcaacttagcctgtagtttatctacatcagtttgtagcatttctgaactatcttttaactctactttgatagttttaataatatccaataatttattataagattcttcagtatatctattagcatcaagtgcttcagcagtttctaataaaatattaagatctgttaaatctcctcgttctacaagtttttcagcagcagctttcaaagtttttgttaattcagctatatcttcactgctgttttcatcatttaaagcatctttaacttctgttagtactttaacaaattctttccatgtagaagcagtataattattttctttataactatcaattaatccatttatagcattaatttcatcagcagttgcttttaaaaccaatgccgcacgtgtttcttgtaatgctgttaaagcatcttccaattgtttaactgtcgcatcatcactggcaattaggtcatgtgccacctttaatgcatctacaaatggtgttgcagtagatgttagatatttactagtatctaaattatccaactcatttgtatctatataattttgtaatacttctttactcactgaaacttttgtaattaagtttgatttagctacttgtaatatgttgaccatatcagcaacttctttaacgctcaattcttcttcacctttagctaataaagtattagcctcattaactttatcttgtaatgcctcccatgttgaatcagtataatcatcagcaactaatgcaccaattttatttaattcatctttaattaattggacattaccacgagtaactaaattagtataagcaatttgtaattcactatatgctttgattattaatttcttatctcctgaagcagttgataaaacttcatttgcctgattcaatttgctaacatacttagcataagaagacgcagtataattattttcatcaacatttaatgagttaacatatttttgtaatgcttctaattctggtaaaaattcatcatcatttaatcttacaatttcagaaattgttgggatattatttgcttcccatacaatcttcaattcataagtcatatcaaatggtaaatatatctcatttagtgatttgcttaaagtgcctacttgtacccactgtttttcttcaccaaccattactaaagccattaccttagcattacttactgtccctttttgaacgatatttattttcttaacatctaaattatcagaaagtgtatatgtaatataccctgcatcagtagtatttggtttatatgctgtagttaaatcaccgtcaaacatattttgtggtacaaatccttgtacttccactgcatttgattcaaaagtaggatcatttgataccggaacatactcaccatcattaattacaatttcattgaataaaactgcacgattattatttgttgctgtcattaaaatttttaaataacgagccttaacattatcagcagtcccttcaaccaataccttattaggataagtacttgatgctttataacctgcatcagaatttatacaagtaacagaggcatcatttttattttctactccatcaccaattgttataacctttgtccaattttctaaatcattagaaataagaatatcagcatcccgaatataatttactgcagaatcttggcagaacatttgaattttagaaatatttctttcttgtcctaaatcataaataatgtattgtcctttttgtggcagatctgcaaattctgttgttgtatcaatattaccatcaaaagccgcaccattattacgactatcttctgctactccccatgaactattaattcccattgttgtttcatataatgaaggagcgtataattcatttgaatgtacttcaaatctattaagatcaaaagtaatggcagaatcagtattattaattattcttacataacgagcatcaggtaattcactagttttagtttttacagtagtccactcaagtgcatttttagatgtttctatagtcaaattatctttattcatatcaacaacaatttcactaatatctttaattcttaataaatcaacaccaatatattgaccttgagttaatgtgattacctcatcatacatcaatttagttaaatcttctttactttctgttatcaatctatattctgtatttgtgtatacatttgtatcatcataatctttaataggatcaaattgagcaacatcaaattctgagaaaattacccaagaatttttctgttcattatttactaaacgaacatatcttgcctctactccacgtaaattctcatcaataacatctttgccgttagtaacaccttcatatgatttatatgttgtccaatcttgaccatcagtagagtattgtaaactgtatttaagccacttgtcacccgcattacgatctccaccaataacagcatgaacttttcctatctgaattgtttttccaaaatcccaaccaataaaatcaccaacgcggctagtatcaccaggcttagtattaaaatctaaagctgtagtgttatctccatccgttagatttgactctgttcctttgtagacttcccatgtatcagtatacataaatgtcttttctatagctgcaggattgcttacactaaaatcataaactttccaccaaaaaccagcactatcattttgtaaatttaattctaaatttctaattctaactgctttaaccgttaagtttaatgctgaaacatcctcattaactgctgcttgaccatcatattttgcaatttcttgccaatttttaccatcaattgtatattcaagcgcatattttgtaattttatcagttttactatcttgaacaaaattaattgttcctaattttttaggatttttgaatgttaaaatcaatgaggcatcaataggtatataatctttaattgtgccacctttatacggatcttcagcaaagtgagcaaatgtagagttatctccatctgttacttttgcaagagtaccgccttgtaatgacaatttatctatagataatgttcccatatcattatctacaataggttcatctgttggatttacaacaatatcacgaattcctaaccaagtattagatttcgcttctgtggcaatcattctaattccttttacattttgtaattctaaatcttctaaaacaacttcatttggtagattataaatagttccatccaaatctttccattctttgccatcattagtaaattgcactttagattttgcaaaagtatctttagaattactatttgtacctaatctaaatatcactttatctacatcaatagcttttgtgtaactaacaccaacatatgtaccttcatttatagaatttggatttttataaacaatttccgtattggctttattatcaaaaacatttgaaatagctccagtaggtgtatcatcacgatttgtaataaattttgttacctgttttgatggatcaataattgatgatgcaacatcagataagtattgttccattgtttttataaacggtacaatatgttgtacccctacttccgcatattcatcatgatcaacataatggaaattatgtgtttttgatctttcaaaagcagcttgaccttgagcatacaagtcccaaatttggtcattttcagcaccatcttgcactgctttgacaccattaattaaagcaatcgctgcctcagtagtatcatcccagcaatctaaccaataaattatttgatcttttatacgagtgtcacctgcttcattacgataagtttttgcagctgtttgtaattttgtgaactcgttaattaaatcggtaaataaatcatcactgattgtattaccactatttaaagcagttttaaattgattcaaacgatcttttaattctactgactcttgtaatggcgttacacgactatccatattttgatttatcatatgttttgatagttcttttaaggcatccgaagcagctgttacttctgcgctattatgatcaacatatttaaatgaatcttcccaaatttcatctgcttcttcactagtttcccaaatattccatgaataacatgcatttccaaaaattgccactttacttggttcagattgttgcattggatttagaacaataccttggatcttatttggatcaacccccggatgtaagaatgtactatatccacccataatcaagtgctttttagaattatcagtacaaggccaattgatccacatatatggtccacgacctacattattagtaaaagttgttgtaaaattatttgaaacttcaccccaaacacgtccaccagtcataacaatttgaacgttttctgggaaattcgtatagtaaccttggccattacccatatattcttgagtacaaaatggtaatgttaattttaaatctggatatgttttttgcatttccttgatccatgcagtcatatctttcaaagttttaatgtagttatctccaccaacatttccagcatcatcagcaagaattgcaatttgacgaacacctgcttcaattacttgagcaaatttagcctgcattacttttaaatcagcttgataattttcttcactgttatatctaattgcattattcatatacggatgcaatgcaaaaacaaaacgacattttgattcattaccagcttgtgctaacggttttatttttgtttcaatttcttcatcactgtataattcacgccatttagaattatgtttagggtcatcttttggagcataaaaatatgaatttaatttataatatcctccccatttcatcaattcagagcgatcttctgttgaccaagggtttccataatatccttcaatgaatcctcgactagctacatcagcgtaatcttccattacaaagttacggattgaataactatccatctggttaaagatatgatataaactagtgattccataaaatgcagcatcagtatctttacctaatacagtaattgtcccattatctgaggctaataaatatgaatctaatttatcatataatccacttgtttttaatgtgtaatttttagatacatgtttatcaacgtatccatctgatcctttaatacctactaagatattagtttgatcttctttaatttcatttgagatagtagcatttatcttcttgattgccaatacctcattcattctagctttagtatattcatcaataccatcttcatatacaatattaatattttgatgaataacgtaatcaccactttgatattccatcaaatgtggtttaggataaatttcataatctgactcagcagcactaacttgtgttggccatgcactaaaacaaccgaaaaccattagtactgccaaaaacatagacatcagtttatgagtattttttttaatttttctcattatctccttttcctttcccgtatagttaatatcgagtcccattcccaaaaattatcaatattagttatacattatataaataaatcaatacagattttaaacaaaaataaagaccaaatataattatgctaaaaaacataatacatatttggtcttgcctgcttagagtaacaatccgtatttacaagtaaatattagcaaaatatttagtaaacgtcaagcgcttccattataattttgcgttcttttttatatgtatacataaataagtttgctcgtctggtgataattcataatcataacgatcacgaattaatttaacaatccgattaatacacagagacaatcgtaaatcttctttcaacatttcccggatatccgctgtagtatcttgcaattcatcaatttcatccctaaaaattctttccgctaaatactttaaatgagttgaaattcgcgcataacctagagaatcctcctctaagtcaactttcattgataatttaatcacatttagtacttcttttgtcaaagtaacaattttcgttgcattatttgccttattatcgagtgaaaagtttactaaatgtaaagcaatataacctgcttcgtcgtcatctaaccgtatccccgttttttcttctatataatcaagtgcccataaaccaactttatattcttttttatataatacttttgtttcactcaaaacaacattaggaagataaatctcttccttttttctttttactgcaaatgaaatatgatcacttatcgctaaaaatatttcaccactaaaatctgtatctaattccttattagcttgattaacaattttattagttatttcaaaatatatagcaggtactgtttcaatcgattgctcaaatcgtttctgctgatcatctttaaaaaaatatgtcttttcaatcctgctttcgtcaacttcatcaccaattctcttttgaaaaccgatccccgaaccagttaaaattatatcacctaactcatctgatattgctgcaacactattattattaaaaaccttgagtatcttcaatgttattgcctccatccatttacattaatatgtcattcatggcatcgacaataaattgtacttcggtgcctatgataatttgtaaattattttttccaatttttataattcctgttgctccagtagctaatatagcttgttcatcaactaaatcaggattacctaattccacacgtaatcgtgtaatacagctatctgcaaactgcacattatttcgcccccccaaagcttctatcaaaacaattgcaatctcatcatagtcttgattttctaatgtaatattgtattcctcttcctcaatttcaattatatcttcatcagtctcccgaccaggtgtcattaaattataacgaactatcataaatctaaaaatgcaataatatataaaagcacaaatcaatccaagtggaatcagcataaatatatcgttagagaacggggctttaatactcaaaatataatcaatcaatcctgccgaaaagccaaagcccgcaagccatttaaataccgcagccacaaatagcattattcctgttaatagagcatgaataaaatataatactggtgcaacaaacataaaagagaactccaatggttctgtaaccccagtaacaaatgaagcaaaagcagcagacaataaaatcgttccaacttgtttttttcgttcaggtctagcactttggtaaatagcgattgcagctgctggtaatccaaacatcattactggaaaaaaaccagcctgatacataccagttactcctttaatgcctccagacactgttccccaaaatttgccaatatcattaattcctgccacatcaaaccaaaagacagaattgagtgcatgatgtaatccagtaggaattaataatcgattaaaaaatccatataatccagctccaactggtcctaatttcgaaatcatttctccaaatgatacaaaacattcataaaaaaacggccaaacaattagtaataataaagaaataactagcattgaagcagtcgatattattgggacaaaacgctttccaccaaaaaaagataacgcatcaggtaactttactttcgaaaactttttataattatatgccactacaagacctgaaattattccaacaaatgcatttgcagaattttcaaaagcagcagaaacttctgcttcgggaattccttttatcaatgctacagccggtggtgaaagcagcctagaaacaatcatataagaaacaaccgcacttagagctaccgttaactctcgttcctgagacattccaatagcaattcctacagcaaataaaattggtaaattatcaataatcgctcccccagattcaatcaaaaaagcagcaatagcattattacttccccatcctgttgggtcgatccaataaccaattccctttaataatgcagcaattggcatcactgatacaggcaacatcaatgattttcccaatctttgcatgtatttcatcattcccatccccccaatcaatataggatttaactgtacctttccattcaatatatttatgtttctaaacacattgattattagtaaattaatgtgttttttttgtccgaacgaaaatgtactatttttcgtgcagaataatatatccaaacctattgtatcactaaagcgcttactttgtgttaaaaaaaatacaacgaactaagttcgcactatgtaagaaattataccttttattatcaaatcatgtcaatagatatatctgtggctatatacattaaatcataactacatattatcattttataaaataattggtataatataagaatatttaaagatattcttgacatataattatttagtcgatattataaatataacgatgttactattaaattaggcattagtgattattttttgatatcactaatgcctttttctatatttaaaaggagataatgaatgaatttttttactagactattaaaaaataaaaaaaatacagtatgtgctcctgcctgtggcaaagttattcgtctggaaaatatccccgacaaagcatttgctaacaaaatggtcggtgatggtcttgcaattgaaattaccgataataaacttgttgcaccatgtgagggaataattagtgttattgctaatactaaacacgcatttgttatgacccttcctaatggtcttcatttactagtacatattggtatcaatagagcaaagccagatgctaataattttcagtatcatgtaaaagccggtgactatgtttctttaggagcagatattgttacactaagcgataatttattaaaagtcctaaataataaggttattacccctattattgtttgcaactatgaatctcaccctattaaaacatttactactgcttcatctgttgaaactggtaaaaccatttttacttataaatgattgagtctaaattaaatgaagccccttatttggataaccaaataaggggcctcatttcaaaaattaggctcgtttttttatttacagtataaaaagcgaaatttaaatttcgctttttaacatctattaaattattcctctttttttcttaacagccagtatataccaacaatagcaacaacgcctaatcctgttacataggcaaaaatatttacatcatcacctgttttcgcagaatcactagcaggaagttcgtttggagtcggtgttggtattggggctactgttgctttttcttctaatttagcaaccgctgtttcaaaattgtttttagcctcaataaattctttagcagaaatatcacttaagttatcaagcatagcttttaaaacattatatgcctcttgatatattttagcagaactttcagtgtatttgcttaaatccactaatgtaatactgttaatatattcttttacttcatcagctttagcacgaactacaagagctttaagtgcattatcaagtgctttgatactagcatcaatttcttcagcagttccattttctaatcttgcagttgcttcagcaattgcatcagctaatcctttgtaactgctagttgtatataattcttgattaactttattagctgtatctaaaatatcttttagatcaccaacaactactaatttttctttagcagcagctaattcactaatagctttcgcaaattcatcagggtgtacaggagtgctttgattatctataatcaactgttcaacttttgccttagcttctagatacattttccatgagttgattgtgtaaagtttttctggatttgtaaccgaagctacaaaatcattttctccttcaattgtaataattgcttcttcttgatttgaaggattaaatactaaattagtatttgctagatcataattagcaattaatttatcaacatctgcaactgaagtattatcaccattagcaattgacttattaattgcctcaatagctttactatatgctaaccatgaaggcgcagtgtaattattttgatcagtatgtgcattagcgataattatttccaatttacttaaatcaccttttaatactttattttcaattgccttgttaattgctctaacggcattatcaacagttgtttgtgaagcatactcactttcaagtacttgcttacctgcattataagcatctccatatgttgcagctgctgcagctgtccatgaagataaatcttccttgttatcaattaaagctttaagcgcatcaacattaagtgtagtgacctcagatttgtatgttgataattctgtaatattaggaatcacatcaccccactcaaccttaatatctaataagattgtattttcaggtaaaacaaattcattaattgcttgtgataatgttcctaaagttacccattgttctgcacttgcatttgtaaataatcttgctttaacaactgcattagaaattacagcactattttgaataattttaattgtgtttacttggttattagatgataaactatagttcacataaccattagcatctttaggaataaacattgttgaaatatccccatcaaccatataactaaataatccatctcttgtttcttgactactagatgtgaaggttggattgttttgtgaaggtataaattccccattatttatttctaattcttggaatctaacccatttatcagctccaactttagttctagtaatttcaaattttaaataacgagcttgcagatttaaaccatctactttttttgcattatatgaaatttcatgacttggtaaaacaaaaccaatttcatcagtattttcagcttcacctgggttattttcattttgattacctaaaagcatgatttctgtccaagtttcaccatcagtagaaactgagaactttccatgacgtggataatcccattcgctatcagtacatatagctttaaatgaatttaaagttatttcttgacctaaatcatatgtgaaatacttgccaacattttgtgatccctgataagcagtagccgtagtaagatcaccatcaaatacattcaatggtttatcgattgaaaaattactacttgtaattgatttctctttaatctcaactgtatttacaataaatttattaagatcaaaagttacttcagcctcattattattaataatacgaacataacgagcatcagcacttacattaccagcatttacgttttgccactcataactatttttagaaacttgaatggtcaaactatcatttgttaattcactaacaatatcttttaattcatgaattcgatctagttttaaacctacataatcaccattagctaaagtaatccctttagctggcgtgattttagcactttcatctaaataatcagcagttaaactcttatattcactaacattagtaaatactttaccattatgatataccttagctgctacatcaaattcacgcatagcaatccaagtgttttgattaaccttattaaccaatcggacatattgagcagtaatattttgatctgacaaatcagtcacaatattaattgtatttttatatgtttcaactgttgtccaagttttaccatctaatgaatattgtaaatcagcatctttaaaataatcaccatcgctatcagtgttaccttgaagaatattaatcttacctaaagtaattggtttagataatttaacccctacataatcacctggaatagttgtatttgcaggttcccctttttgtctaacattataatgtactttagtagttaaatcaccatcaataagattagcatcactaccaccataaatactccatccatccgtagtacggatcacttctttagtaaattgttcctcttctgccggttgtgtaacaacagtaaattcacgcattgccggccatttgtttccgccaccaacttcgctacatacataacgtacggcaacaacatcttcaatttcaatattagtaacatctacttgtgatgcatattcaccatatacttctttatttaaatctttaaaagttgttccatcagtagaatattgtaattttgcataaccaaaagtatcttcttttttatcactattattagcaccatttaaaatatgaacaccataaatagtcgttggtttacttagatccacttggaaatattgaccagctttttcatatccattatgccatgctgcagtatcattattaccatcaacaatatcagctattttacctgaatgccaagtagtaaagcttgatgaagcactaatttctaatggttgttctgtttctccactagcaatatagtcattaattggtcctgaaagtttatcttgtaaagcttttgccaaaggaatcaaatgtgttgatccaggactaactttagctgttccatttaataatttacggatatgattttgactattaattaattctgatgatgcatttgagaattgattaaaagctgtaaccatatcattttcttcaattgcaattgctgattctgtaaaatgtttaattgctgtcgttaaatcttttaaagaaccggtaaaagataataattcttttttcaggttttcatttttactatttgcatggaaaccatcacaagcatcaataatcacattcatttctgcaattaattgttttccactttcaataattgaatcaccattagctaacttagttttaaactcattaattaatggttgtaattcttcagattcagctaaaactaagccatgaccattaggttgaggattagacatatgcttagctaatgtatgtaattcctcacttgcctcttgatcaatatatttaaatgaatcagcccaactttgatcatcattaaagcttttaacattccatgcataatcagctaccgcaaaaatagccactttagaagcttcagcttcttgcattggattagttactaccccacttaaatcatcaatattaatatcagtgtgtaataaacttcctttccccatcattaaacgtgaaccgttaatatcattgacaggccagttcaaccagaacagtggacttcttctttcgtcagccccttctggtaatctgtttcttttaaaatgatctaatgttttttgttcaactggttgacacactgcttcaccagtccagaaaattttcacatcttcagggaatccagcatcataatcacttaattcagaataatccccttgccatgaatgattatatcctgctggacagaaaacagaatcataaacatctcctttttcttttgcccaagctgatacactattcatcattttaattacaacactacggtctaggctaccaacatcatcaccaagaacaccaaattggcgtaccccagcatcgtacaattgatcaaactttttaagtaatgaagcaatttcttcatctactttagatgcattgaaaccacccataaatggatgggctgtccatacaaatctacatttagaatcatttcctacttgaaccatttccttaatggctgcgagttcctcttcaggatataattcacgccataaatttttatgatatggatcatctttaggtgcaaatacataagaagtcattttgaaatcaccaccgaatttcattaatgacattctatcttcatttgaccaaggaatcccatagtacccttcgataaaaccacgaatatcggtatcagcataatctttaattacaaagttacggattgttgatccatccatttgattaaaaatatgttttaatgaggtaattccataaaatgccccatcagtatcttttcctaaaataacaatttcaccattatttgaagcaacaaaatgcgccccaaatttactaaatagactctcttcaacgctatagttggatttaacatagccatcaacataccctccagatttatatgtaccaactaaaatatttgtttttccgtctactttctgcttagatgtgctaatttgtttattttttgactctaatacttcagtcattctctttttagtagcagcatcaattccatcttcatataccacattaacttgtgaacgaataacataatccttatcttgataagtaatttcatgtggtgttggataaatttcataatttgtttctttagcttctacttttatatttggtgacataaaaaatagtgtactaaatacaaccaacattgctaatgaagattttaaagctttgtcccaaaatcttgccatctttttcctccctaagatttagtcaaatggattagaaaaataaaagaccgatatacagaaaataatctgtacatcggtcttgcctaatctaatagtaacaatccatttacttcacgagtatatcatgacaattatcccctgtcaagaaagcgattacaaaaaatggatttatcaagcatcttttgatttaaccagaaggattggtttactatttgtgatagttgcaatttcacaacttacttgattggatacacataatggatcctgtcgttgtaaaaaatactgattcaatgggtactcagcaccatcaatatcaatataagcatcatctagtgcatataatgaaaaatacttatattcatcttgatacaccttatgtgttcccggcaataataattgaataacattttgctgatcaataattctaatttttttatctgcatatttttccaaaagacacataacgctaagaaaatgatctaagcgaccgcccgtcacaccataaatatctacttcatcataaccattctccaaagcatattctaaagctgcatgtgtatcggtcacatctttacgagttggcaatctttctatatctaactcacttaaaacattctcgttttcaatcgaatcaaaatcaccaattgcaaagacaggcttaatcccctgtttaagtaatatttcaacaccatgatcaacaccaatatattttaaactgtcatcgagtttacaagccagtgcactacaaatacctatcttcattttagtgactctattgctttcgtataatcatcactaccaaaaacatagctgccggccactaaaacgtcaactccagcatcattacataacttggaagtcgattcattgattcctccatctacttcaattaaataatgataattattttcttttctgagtgttgccagctgtgcaattttatcaacagctgccgaattaaatttttgcccaccaaaaccgggctcaactgacattactaaaacaacatctaactcattcaaaaatggttttagtacttctactggtgtatccggcttaattgatagcccgacctccacatcatgctccttaatatgagcgattaattcattaatcttatcttcagcaactgcttcataatgaaaaacaattaatgacgcattactattaataaaattatccacatatttagctggatcagtaatcattaaatgtacatcaagatacatatccgttactttactaacatcttttaaaatactatatccaaatgatatgtttggaacaaaatgtccatccattacatcataatgaatccaatctgccgctttgattgcgttaatctcttctttcaaataagcaaaattagctgataataatgaaggtgctactttaaccatacttccgttcctctttcttttttacatcttgtaaattcattaaataatgctcatagcgttctttagatatttttccatcttcaacggctttttttaccccacaattaggttcactatcgtgtaaacatcctctaaacttgcattcatgactaaattgagcaaaatcatgataggctacagctagttcttccggtgtcatttccaattctaatgaagaaaaaccaggtgtatctccaagatatccaccatacatcttgagcagttcaacatgacgagttgtatgttttcctcgcccaagagattttgatatctcatttgtttccaattttaaattaatatctaaggcattcaaaaaactacttttgcctaccccactttgtccagtaatcactgatactttatctttaaagactgtttttaattcctcaagcccatgattatcttttgagcttatttcatatacccgatatccagcctgacgataatctttaacatattgtttaacgctttcatcttcatctaaatccattttagaaataataataattggttcaattcctaaatgctcaattactaaaagaaatttatctaataatattgatgaaaaatcaggttccttacaagaactaacaatcagagcttgatcaacattacaaataggtggtcgaactaaacaattatgacgaggcaatacattcattacatagccatcattatcaccttcgacttcatattcaacaaagtcaccaaccaggggcttaatctcatccttacgaaatttccccctagcacgacattgaattatttgatgatcatcttcgacataataaaaccctgctaatgctttaataattcttccttgtgacatctctacctcctaatcatctgtaggtatttcaggtttataattataataataaagtgtaatagattcattcttcttagttaccgtagtaaaggcatctaaactttgacggactacttgatttacagtaatcttttcaatttcatttggatctgtaggtgttggcaatgtttcccgtttaactgaaaaacctttatttgttagtaaggtcgcagcagcatcaatatccattcctttaacatttggtacttcaattttaattcccgaagaaacagtcaatgtaattgtccgatctttttcatcaggatcaaccttatgcccttcttttaaactctgttcaacaactgttccaactgcttgttctgaactagtttctttgatcgtaacatcaaacccaagttttgtcagtgcttctttggccttattttgatccattcctacataattaccaagaactacataatcaccttttgatactgttaaaataattttacgatctttttcagttggatctactttagttcctttttcaatactttgatcaattacagttcctttagttttagaagatatctcatattcaatctctacttcaaatttcaatttttctaatgcctttttagcaacatcttctttttttccagtgtaatcttcaagaacaatatatttgcctttcgatactgttactttaacgacatcaccttctttgatcgtcgttccttttttagggtctgttgcaatgatttcacctttttcatattcatcagatagttcttcagtaatatcatcgctaatagtaacattatattcttttaaaatttcttttgcttgttcaactgttttttctgttaaatcaggcattagactagtatctggcttcactccaagataaatcgcaaaagcaattcccgcgataactaaagcagtaaccacaccaactcccaccttagcttttgtatctaaacctttaaatttattaactaatttactgaaaaaaccttcttttttaggggctgccacttctttttcttcaactggatctacgattggtgcagtattgccactagtaaatgcggaacgaggatcaataacaattgttggatcagtatcttggtcatgtgaaaaaactaatttttcttcatcctgacgctccatacaagtctttatatcatccaacatttctgttgcacttttataacgatcattaagatttttagcagtagctttaattacaatattctcaacagactggggaattgaaggattaaactccaacaatgatggtagatcttcctgcatatgctttaatgcaatattaactggtgattcaccattaaatggtacttctccccgtaacaactcataaaaaacaattcctaaagcatatacgtcactttgggcagtcgctttttcaccacgtgctaattctggagctaaataatgcaatgagcccataataacatctgtctgggttacctgcgctagagattgcattgaagcaattccaaaatcggcaattttagccactccactatcagtaaccaaaatattttgcggttttaaatcacgatggataatccctagctgatgagctttagaaattccactaattacttgtttcataatatcaattgcttcaactacatgaacagcaccacgctttaaaatcaactcttttaacgtcatacccggcacatattccatgacaatataatatttatcttcatcctcaccaacatcatatatttcaacaatatttttatgagaaagtgcagctgctgcactagcttcacgttgaaatctagttacatatattggatctttagcaaggctagttcgaagaatcttaatcgcaatagtacgatttaagataatatcttgagctaaataaacatctgccattccgccttgaccaattagttctaacaattcataacgttctgcaattatttttgccatcctatttttcctcccgattatcaatgatagctactccgatattatcacgtccaccattttcattagctcgatcaattaattcagtaactttttgagatacttttatattcttttttaaaatttctttaattatttcatcatttaagcaattatataatccatcactgcaaagcaacaataaactatctgcaaattctaattcgataaaagatggggttaattcagtatctgcaccaattgcctgagtcaaaacatttttttggctatgattaacagcttcttcttcactgattgctccacgatcaactaaagcattaactaaagtatgatctttagtcaattgcattaattgatcatttttcaaaacataagcacggctatcaccgacatgagaaatatatatcacattatccattaaaattgccacgacaattgtcgtacccataccatgatgctcaacattttgcttagccattctttttacaatcgcatcagcttcataaattgtttcatttacccattttttcaactcatcaacattatcaaatggggggatactgtcaaaacaattaacaaattgatccatcaccacccgagaagcaatttcaccagcacgatgaccacccataccatcacagacaattgcaataacttgatcttttacatttgcaataacagtagcctgatcctgatttttatttcgtactttaccgatatcagtcaatgcataatagttcattatttcaccccacttcttttagcccttaattgtccacaagcaccatcaatatcgcgcccatgttcttttcttaaagttacattaatatgtaatcttaatagctcatttttaaatatttctactgtttctttatcactaggttgataaccatgctcatcaacactattatatggtattaaattaacatatgcatttaatccacgtagatagtgtgccaattgacgagcgtaaacaatatcatcattaacaccttttaacatgatatattcaaaagtaacacgccgatttgttttatcaatatattcactgatagcttcacgtaaatcatccattggatgcaccttattgatcggcatcaattcatcgcgaatttcatcattagcagcatgtaacgaaatcgccaaattagtttgaattccttcttcactatatcgcttgatccctttgatcaatccacaagttgaaatagtgatgtgccgagcgccgatagctagaccatgtggatggttaatgatccgtacaaattccatcacattatcataattatcaaatggttcacccgtccccattacgactacatgactaactcgttgatcaatatcttgttgtactttaataatttgtgcaacaatttcacctggtgttaaatcacgttgtttgcgtaataaaccactagcacaaaatgtacatttcatgttgcagccaatttggctagttacacatagtgacttaccatagtcatgaatcattaagacagattcaatcaaacttccatctaataattcgaacagatatttaattgtcccatctcttgatacttgtttttctttaatttttaaaacatctaaagaaaattctactttcaattgatttcgtagatcttttgataaatccgacatatcatcaaaactacgagcatctttctggtaaagccagctaaaaacttgtttagcacggaatggcttttgtttgattgaagcaaaatattcagttagttgttctagtgagtaatcataaatatttttcatcttattttcctttttctaatttacacatataaaatccatcactgtcataaacatacggtaaaatcttcttttcttcaattatcttcatatctggatatttatcaagaaattgttttatcatttgttcattttcttttttattgattgtacacgtactatagaccattttaccatttttcttcaataaatagtaggcattgtctaacaattttgcttgtaaaggaatgattgtatccattgcaccagaatcatgatatttaatctccggtttacgtttcattactcctaaaccgctgcaaggtgcatcaagcaaaattttatcaaatgattcttctgaatatttttctttcaacaaagtggcatccccaacatgcagttctacattattaacacctaagcgttttagattagcttcaactagcttgattttatgttcaaataaatcatatgcaattattttaccctgattattcataatagctgctaaatgtgtagttttacttcctggagcacaacacatatcaagaacgagatccgttggctgaggatccagcaacggagcaatcaactgacttgactcgtcttgaatagtgactaacccgtttttaaaataatcagtgttagcaatatttcctgctctgtacaagagtccatcgggagaaagattccctgcttcaaaattttcatcagttaataattgagcctttgtagtctttaaaatattgaccctcgctgctctggttggtggtgtattatcatgctgacaaatctttttggctatatttaaatcatactgtttacttaacatcttaactatccataagggatggcttgtttcaatagaaattcttttcaattcatccttctcatcaatctcacattttccattacgtaaaaaatttcttaaaatagcattaacaaatttccccgcaaaattatcacgtttctttgctaaacggacagcttcatcaattacagcataatccggaaccttatctaagaaaattaattgatacaatgacatcaataaaatcattttctcacgatttttaatttttttcccttgaatatatggcgccaattgatattcaagatataacttattttgaatcgttccatatacaattcgtgtagccaaatctttatcatttctagataataagcttttttctaaatagtcatttaaagtaatatttaaataactttgctcattttggtattttattaatacatctaatgcagtcgttcttgccataaatagtccttcctatatttgattatatggattaaagtcacaaaccacatgaactttatttccttttttattataaaaatcactcatcttttctaatactggatataattgtttactatttgtaaatttaatcataatacgtttacgataaatatcctgcatccgatagatcaaactatttgccggaccaagaattgccattttatcaagttgtttttgtaaatactcttttatttgcaccgcactttgattaacaacttcttcatcttttccttgtattaaaatgctcactaaatgaacatatggagggtaagctgctaattttcgtgttttcatttcttcctgataaaaacgaagatagtcgtgattcttgacacattgtaacacaaaatgctcaggattgtatgtctgaatcattactgtaccttctttttgaccacgtccacttcgtcctgaaacctgttcaagcagttgaaaagttcgctcattagcacgaaaatcagggatatttaaacttatatcagcatttaaaacaccaacaaaagtaacattttcaaaatctaatccttttgctatcatctgtgttcctaatagaatattaccctctttgcgagcaaacttatctaataatttttgatgcccatccttttgtttagttgtatcaacgtcataacgaatcacttttgcaccatcaaatatagtctccagctgttcctctactttttgtgttcctgctccaactaattttaatcgttcacttgaacaatgtggacaaagacgcggcatttcaatttgatgttcacaataatgacaacgtaatttgtgatccgccttatgatatgttaaggttacatcacaatgaggacatttaattacttcaccacaatcaaggcaacgaacatatgttgcataaccacgtttatttaatagaagaattacttgttcatcatgatccaggcaggtttgaatttgttccttcatcgcttttgaaaaaagtgaataatttttatttctaatttcatcagccatatcgatcaattcaatctttggtaagggaaactgattgatccgctttggtagctcgtatagatcataaattcctttttgtcctcgactataagattctagtgacggtgtagcactaccaagaataacgggacagttatggtattgcccccgaattcgagcaatctgagtcgtttgataccgtggcttgctttcctgtttataactaggatcatgttcttcatctaaaataatcaatcctattttttccaaaggcgcaaataccgcacttcgagcaccaacaacaatcttaacttcactattcaaaattcgccgatactcatcataacgctcaccagcagataattttgaatgtaaaattgctacctctttcccaaatttgtgtttaaaagcattgaccatcatcggtgttaaagaaatctccggtactaacattaagacagttttattatttctaatcacatatttagataaatgtagatacacttcggtttttccagaaccagtcacaccatgaattaaagcagtatgataagtatcaattttgctcatgattccattgactactttttgttgatcaacagttaaagaaaactcatgttcctctttttgatcatctaaataagggtcacgatataattcctgttcgattattaccgttaccctctgttcaattagcttgtcaagcagtccacggctataaggaaatgcttttagtggcgtgtcgggatgtgtttttaaatattgatacgcttcttgttgtttaacagttttaagagtagcatcttcattaataactttaattactttttgatacttaattccaacacttttatttgtacttggttttaattgaggtggcaacattgcttgaagacagctaattcgtggtgacaaagttaattttgctaatgtcaaagacagctcttgtaattcttgatttaataaggggcgctcatcaataacttcactaatatagcgatatttaaatcctgctgctgcttctaattcctcttttgttgaattgctataacgacatcccgttacatatccgattattcgttgatatccaaacgcaattgtcactctaaccccactagcaatttcagtatttgctaaataatcaaaagtagtgtcaagagcatgggttggatgttctactaatacttgtacaatatacaccatcatcatctccaatttgtttctattctaccacatctacaagataaaataaaagagtcgattaactcttatatctttatagcaaagtatctaattgctctcccacgttttttatttttggatgatctatcatcttaccacaaacatctgttctagcgaaaaattagcgagtaacaccgctggtaataaagtgcaaattaaactagcctgatgacactaaaagcttttattgatgattcatcaagatagatattaagatcatgtttcaacacataatcatgataaccatcaaaaacagttgcatgagttaatacatacttcattgcattcactctcttttaaaaaaaggaatctttgcgattcctagacatgataaatataattatcttttcgcggtttagcttctggtttcggttctttaccataacctaaaatacaattaccgattcctacatacttttcatcaatgccccactgctttaacaattcttttccctcagtactcataaaaacttctttggcacgatgaatccaacaagaatctacgccaactgcattggctgcatttaaaagattccccattactaacgcaccatcttctaaatatgttccaatcgttgaatcccctaaaacgactaccactgttggtgctccataaaaaggatcgttttcactatccattattgccgcattcaattttgatagccgcttaattatctcaggattttgaataactaccataattgcagattgacgtcccattcctgaggctgcatatgttccagccgtcaaaatttcattcaattgttcttcgctaatttgctctttttggaagcttcgaacacttcgacgtgtaattaaattattgattgtttcattcattatactatccccctttttataaggatattatatcacagacttaatgaatattaagatatagataattgtttttaagaaaaatactctatataatttagataaaaggagggctgtttatgtgtaaaaaactatcaataattttactatgcctgcttatgataacaggatgctctaaagacaagccaattttatatagcaatcttggtaatcaagccagtcaaaataaacttactaatattttaaatgaagctgacctccccaaagagaatattaaacaattcttttcctatgttaatacctttaatcagcacgctacacccttaattggtgattttgaaactttagaaagagaacaaccagattaccaatattttaaatataatagcccagttgaaataagtgatcaaaacgattctaattcactaattccttcatttatcttaataaaaaacctaatttatactaataatagcggtcacgcagatgactcatatattatgtttaatttaaatttaattgatactattgatcagtattcaatgagccaagaagatcgtttaaaattcattactacttttaacagcatttctgttaccggcataaaaaataatgaaatttctcatatcaatcaaattgaaaaaacatttagtgatcgtgactttagcgtaaaacaaaaccaaaaagcatcattgattaccttgtggcttcactcttccgcagataaccgtcgctttgttagccactgtggtgttttaattgatagcaatgacggtttatattttattgaaaaatacggttgtttttatccttatcaggtgacaaaatttaatagccgaagtgaattaaaaacgtatttattaactcgaaacgatctcaaaggagatgaaaatgacggtttgccactcgtttttgaaaataataaatatctgaataaataattaataatatcctttgaataaattgtaatacatttttatattagttcctagatgcagaaccacgactttaatccaacagtatgatttcggtgctgaagcactgaccatggcataatctaatttgaatttccgagcataatgatctgcctttcgtaaatgccagctatttgtaacaactagagcatttttcaatccatttatctgcattatatcgcggctatacatcaaattatgatatgtacttcgagattgtccctcgataaggatatcttctttttttacccctaaactaattgcatatgaagccattattttcgcttcctgatattcatttttaactgccccaccagataagattaaaaatttaatcttatcttttttatataaagtaacacccatttcaacccgtgatttcataattgttgatggctcaccatcgatattagcaggataaccacaaataatcgcacaatcatattttttataacgctgttttttatatggttttttaaatactaataaaaatgctagtagattcaatattccaaatccaattattactcgtttgaccattttattacctcattattttacatttcccgggaaattgtaacaaaagggcctaatggccccgatgtttcgctttacgtttttgctgtttcaatacaaatagatgctctttttcagccgttcgctgctcacgacgaataattttattctttgccttattttgctcatattgtcgtttcaacgcttgcatcgatttagtacctgtttgtaagttcatagattgttttctaatcatccgttgtaatcgcttaggattttttggtttatctttatgtttcgctttgaactcagcaacaaaattaagtttatggtaattatttaaaaaataaacatatatctcaccatcacttggctcttgaccgaacacaactcgttcaacgtaacacttatctccatttgttaaataaaatactccaatccaaaacggatcatcaaataaaacatttaattccaaaccaacatccaacatatcgctatcctccttgaaatttacttctaagaacggacaacctcaggagggcaggttactgatgcaaaatgcacaacttgactaccaacaagttcgtgtttttatcttagcaaccatattataacttatttttcagatttatttaagaggaaagctattcctgctaaccctaaacctaatgcgattataataaataaattaatacttacatcattattcaaataaaaatatacttttaaatcatcatatagtcccatcaaaactgcaataattaataaaaaagctagtaaaaatggcacttttagccgtccatcattttttttcataaaatcaaacactttagcatcaaatactttaaatgcatctaacaacatgtatattcccaaaatagctaataacacaataatgtcggttgggcaaaaaattaaatcaagtcctaatttaccttctaacccttgcgccaaatataaaattaaaaccattcctggataaaaaatatacgcaaacaccttaaaatactctttaaacttttccatttttcctcctactaaaaatcagggatatttacccctgatttgtttgatgattttttataatttcagcaattttatcttttgctgccataacgtcatcattttccactacatatttatattcatctttagtcgcaatttcttttcttgcttttgataaacgttgttggacaatctcttcttcctctgtacgacgtccacgaattcgtcgttcgagttcttctaagctaggtggtactaaaaagattgttgttgcatctggacatttttccattacttgaagggccccttgaacttcaatttctaaaacaacatttttaccttcatttaataattgatcaacgtaatctttgggtgttccgtaataattaccgacaaactgcgcccactctaataactttccttcttcaattttacttttaaattcttcttcttcaacaaaaaaataatcaattccatctctttcatttggacgtggttttcttgttgtcatcgaaatcgaataagcaagatttaaactatcgtctttgaataattcttctcttactgttcctttaccaacgccactaggcccactaagaattatcaacattcctttttgcactgtctacaccccttttttttgataagttcatcatacaaaatacgtcttatattgtcaattgttttcaaactatataatgtcaattatttttaatctatgttatacttacaacggtgataaaaaatggcatatgatggaataatgatgcatcaagtaattgatgacttaaacaaaacaataactggtggtagaatcaacaaaatctaccaaatctcaaaatatgaattattgattcaagttcgtaataatcgaactaattacaagctgctgctctcctgccatccaatgtacgcaagaattcagctgactaatttagactatcctactccggaaagtccgaatcctttaacaatgttatttcgtaaacatcttgagggtggttatatcaaaaaaattgaacaaatcgaattagatcgaatttgtcattttctttttggctgtcataacgaatttggtgattacgttgaataccattgttatattgaaattatgggtaaacattctaatattattctttgcaatcaagataaaaaaattcttgattgtttaaaacgaattacccctaacattaatagtgaacgttttgtacaaccaggggcaatgtaccaattgccaccaatgaatcaaaataaagttgatcctttcactagtgattttattgaaaacaataatctaacaaaaatatatcaagggatgtctccaatcctatctaaagaaattctttatcgtcatgataatggtatagattttaaagagattatggatgaaataaaaaatagcgataccctttatataagtagagttgatgaaaaagaatattttcatttaattccattaactcatctaaatcagcaggcacagtcttattcattattcgatggtctggataaacattttaatttaatcgatcaaaaagaacgtataaaacaacaaacatcaaatcttttgaaatttattaataatgaatatcaaaaaaatgttactaaacttgcaaaattagaatcaactctagaagattcgaacaatagtgatgaatatcgaatcattggcgatcttttatactcaaacttacatttattaaaaaaaggaatgcgtcatgttgaactagataattactatgatggttctaagattatggttgatttagatgaaaaacttgatcctaaaagtaatgctcaaaaatattataacaagtatcaaaaggcaaaaaattcaatcaatgttctgcatgagcagattgatttaaccaaaaaagaaattgaatattttgacactcttttaacactaatggataatgcttcatactatgatgccctagaaataaaagaagaattagaaaatctaggatatttaaaaaagaaaaagaaaactaatacgatccgtaaaaataaaaaaccttcttttgagacatattatactaaagatggtattgaaatatgtattgggaagaataaccttcaaaatgattatctaacttttaaacatgctcatcgctatgatacctggtttcatgttaaagatatgcctggtagtcatgttgtcgttaaaggtgatcaattagatgaatatacgattcgattagctagtaatatcgctgcctattattcaaaagggaaaaacagtagtagtgttcctgtcaattatactttaataaaaacattgaaaaagcctcatggcgctaaacctgggcaagtaatcttagataattataaaactatttatattgatcctgatcaacattgcctcgatgaattacaaaaaaaatagatgcctgggcatctatcttttttagcggttacatccacatccgcttcctccgttattagcgttgttatacattccattaataacagagtcacctgtgttattagctgcgttaaatcctgtacctgctccgttaaatggagtagcgttagcagcacttgcgaatggatttccattactttgagtcatgaaagtacgttcataacgtggataataacgtgggtaataaacgatattattaatatggcgacattcgattgggcaaataattggttgttcaacatattgattagagcagcttgtacaaacttttcttggtgcaacgattggagtagcacggcagcagttcattccactgttacatcctccacatccgcagctgttgttacaaccacatcctgagttacaaaacatcatttccacctcctttaatatactatatgttcgattaaatttggtgctaaggcaaattacacagaaaggtctaaattatgaaattaatcaaatggaatactgttgaaaacattgaagcatatacaattactaaagaattaggcgatatgtcttataataacgaggacaaacaattgattctcaataatcgtaaacaattagccaaacttttaaaaactgatttagagcacatggtggcaccacatcaaacacactcagccaactttaaagaagtatctcttaaagacggtggcagaggtatgtactgccaagatgatgcctttaacaatactgatgctctttatacaaaagatactgatctctttttattatcatttcatgcagattgtaccccagtgttactatattgtcctaaaacaaaaataattgctgcaattcattctggttggctaggaacaactaaacaaattgtttcaaaagtcacaaaacatctaattgaaaatgaacattgtgatcctaaagagatgcttgcctatattggaccatgcatctgccaagattgtcttgaggtaatggataatgtcatcgacttagttaaacaaatggatttcgatactactccgtactataaacaaacagatactacacattatttgcttgataacaaaggtctaaaccgacaaatgttattaaatttaggtttattgaaaaaaaatattactgtttcgccatattgtactgttgaaaatgacaagttattttatagctatcgtaaatataaagatagtggcagaaatatcacaatcataaaaagacaagcttaaaggactataacaaataaagattttcaatctttgatatgttcccttctagatgacaagtttttattattttatttgtctacctaggaggaagcatatcactctaggcgttatagccctttttatttattaaatcagttttttctactttaattgttaatatttattttttagtaattaaattttccataaaattacataaattggttataaatcagttacaaaatcacattttaactacattaacttatctttttacttgttaatttttttatatgtttctcgatgaatgatataataaaagtaatatatataaacgataattgaggtgattttgtcgatgaatgaaaattttaattcagcattctacaagaagattcttgatcaaattaactctaatatctatgtcaccgatgttgaaactgatgaaattgtatatatgaacgattatatgaaaaatacgtttcaagtctctaacactgaaggaaagaaatgctggcagattttacaatctggaatgaacaaaagatgtgagttttgtaaaatcaaacaacttcaagaatctaattcacaaaaaatttgtgtatggtatgaaaagaacacgataacagaaaaaacatatttaaatcatgatactttagaactttgggataacaaactttatcatatccaaaattcgattgacgttactgaacaactacagttatctgtagaagcaacaattgatgaattaacaggtatttttaatcgaaatgccggtaaaaaacgaattgaagaactattaactgctgaatatcttaacgaagactttgttgtagttttatatgacatgaacggtttaaaatgggttaatgatacttatggacatcttgaaggcgatcgcctattaatatttgttgcccaaaatataaaaaagcgtttgaaagagccaaactttatctttcgccttagtggtgatgaatttataattgtttttttagatactactgttaaaggtgtagaagtttggatggataatattcttttaactttaaatcaagaaagaatcaaagaaaacattgattatgatacctcttttagttatggaattgctaatatccatgtagatgaaaatttaactgtttctgatgtattatctattgctgattcacaaatgtatatccaaaaacgagattatcatattcttatgaataaaaaaaggctaacaaattcacaacctaagtataattctattcctttatttgaatataatcgtgatcatctttttgaaagtttatcagaaacaattgatgactacttatttgttggaaatttaaagacaagtaaattcatgtactcacgtcagatgatgatagattttcgtttgccaaatcaaattcttgataatgctgcagcattttggggagaaaaaattcatcctgatgataaagcaggatttttaagaagtaatcaagaaattgctgatggcagagctgaacagcatacaatttattatcgtgcaaaagatgcctctaaccgttggattcccttgctttgtaaaggaaaaatgattagagataaaaatggtaatccagatttatttgctggaacaattcgtaatttggataaaaatagagaacaagcttctctagagccaaattctttagatacttatttagatacttcgtattatatttatgagaaaaatcaaagcaataaaaataattttctttttcaaaaaagcttttactttgtaaacatatttgatcagcaaaatgatttaaaaacaaaaactgacttacttgattttgtaaataaaaatattccgggaggaatactagctgtccaagcgcactctggctttccactctattgctttaatcaagccattttagaatatacccaatattcttatgaagaattatgtcaaataacaaatggaaaattttcaaatattatctatgaaaaagatcgtcaatttgttgaaagagaaattttccaacagcttgaaagaaatgacatttatgaaattcgttatcgcatagtttgccacggaggccatttgctttgggtatatgaaagaggaaaatacgttatcgatgggcatggtcaaaaactaattttgtctttttttgttgatatttcccatgaaatgaataatgaacaagaactacgtttcattaatgaaaatagccttgacggagtttttaaagctgcattaattgaacattttccaattttatatgctaatgacggatattatcgaatacatgggtataccaaaaaacaatttcaccatgatttaaatgattgtgctgaaaatctcatttatgaatcagataaagcaagaataagagcccaaataacggatttaattaaaaataatcagtcacaagctattcttgaatatcgaattaaaaaacgagacaattcaattgcctggattcatattagtgccagctttacttcgctgcttgatcaaacaattattatgattggaatggtcatggatattactaaacgaaaaaaactagaagataagttatatcgctcacagcagttgtttaaagttgcacaaactaaaaccggcttaaatatttgggagtttgatattcaaaacaaacaagtaattggcaatcccgattctgcagtaatccgcagctatcaaaatcttactgccaatatcccagaaagcataattgcacaagggttgatccatcctcaaagcattaatgaacttaagaatttatatcaacgcttagaaaaaggagctgctcccctttctgctacaatcagggtcaaacaaaaagatgcgaaagataaatatctttgggaaaaaataacatatactattgtccagcatattgatgaaaaaccagcatgggcaattggcatatcagaagatgttacagaacaaaaagaaattgagacaagaatctataatgaagaaagtttaaggaaagttttgaatgaagatattatattaaacatccgtttaaatttttctcgtgattttatcgaagatatttctttacattccaatgaacagtatgaaaaacagctctctgattacacatacgatgatatttataaatatttattacagactattgctaatgaggatgatcaaaaaaaatttgagaaaaaatattctaaaaatcaaattaatgactatatccgtacttttaccgatattccaacttttgaatttaggcagaaatatttaaatggaatgatattatgggtatccttaaatatgaaaacaactatttctcctcaaaataacgatgtaatattatttatttataccaaaaatattgatatccaaaaaagacgtgaattagcattgcaaaataaagcagaaattgatgagatgagtagcttatataatgagtctacttcacagctaatgattgaaacattgctgaagaaagaatatgatcctaagaaagtcaatgcttttcttttgctagatattgataattttaaacagataaatcacagtgggaatttcttgttcggtgaccaaatcattcgtcaaatgggacaaatgatcaagaaaagtatttcttccagctgtattgcagcacgaatcaatggtgatacattctctattttttatcataatgctgaatcaaaaaaagttatctatcaagcagccttacaacttcaaaaaaagctttctagtatttatcattttcaagatattgagacccagttaactctcaccggtggtttaatctatctattttcagaaaatatgagctatagtcaaattcatcaatgcgcactccatgccttagatacagctaaaagacgcggaaaaaaccagatactatcttatcaagaaattgaaaaagttgaatttaatttcaagattgaaatgattattaaccctaatgattttacaattttatcgatgagcccgactggacaaatcatatttaattgtattttcccagttaaaaagccaataaaatgttatgaattattacataatcgtaaatcaccgtgcccattttgttctcaacaaatcgactttgaacaaacaaatatgcgtgaatgttttgtatccaaaatcgataaacttatgtatgttaaagaacagctgtctcattatgagggcgatactgtaagaaaaattgaaatgcaggatattccctttaacttagcatatgaaaatcaggattcagatttacaacaatttttagaaataagctggaaaaatatagataaaaatattcaacgagaaaatgcttttgataatattcttagacaattaggaacattctttaatgcccaaaatgttctcttatttcatcaaagcgataatcaacaaaaattttctctgacttcaaagtggaattataataatcaaatctctaatattaaaaatactcatttcagtaaggaacactttgaaaatattgttagtgctgtcgcaccacaaaaatactttgtaatattagataaaaaccatttttgttataaaaatattacagaactatattttgaaaaggatgtaccactaccattattatttatcggtatttataacaaaaacaagcttgtatcatgcttgctcgtggaaactgttaaacaacatattaacgcttcaaaatctattgaggtgattgctgatgttatttgtaaaattaccactatttataatttgcagactaaatatacttatgcccttactcatgatcaaaaaaccggtttatctaactacgattcttatattaagactataagaaatataaatactgatatttattctacttttggaatgattgaaataactatcattaatctaaaaaaatataatcagcggtatggcatcgtccaaggtgatgaaatcttacagttcatcgcacaaacaattactaaattttttgataaaaaatcatgttatcggatcagtaatgcccattttatagtgctttgtccagatattacgtatgaaaacttcattcatatatatgatactttttaccaagagctaattgaattttatgatcaatggatcatttgtgaaaaagtttgggaaaagaattcacttgtgttagaaacaatgcaagagcaattagaggaaaaaacaagacatgctgtaaataaaaaaatacactctaagttagctaaatctgatcagtcgatagcaaaaatattagagcgtttaaatactgcttttgtaaatggaaaatttttaacctttttacaacctaaggctcatactaaaactaatcaaatttgtggtgctgaagcattgatcagatacaacgatcctcaaaaaggaattattccaccagggcgttttcttccagaaatagaaagagcaggattaattagacatatagatttatttattctaaaagatgtctgccgaattctcagtaactggttaaaaactacttggaagcctttcccaatttcaataaattattctcgagcaactattttagaacctggtattttagaagaaactaataaaatcgttgaaagctataatattcctaaagaattaattgaaatagaagttactgaatccattggatcaattgattctgctagtttaaaaaatattgttaatcaatttttagctgaaggatataaaattgctttagatgacttcggtgctgaatatagcaatatttatatactatactcgctgcacttaagctcacttaaacttgatcgaaagatcgtaagcgatatttatcatgatcaccgtgctaaattagtaatcaaaaatatcattaatacgtgtcaacaattagatataacttgtgtcgctgaaggagtagaaactaaagaacagctaaaagtgttaaaagatttatcttgtgatgttattcaaggctattatcttaataagcctttatctgaagatgatttcaaaaagatttctggcatcactaacccccattgacactaaaacaaagataatcctaagatagttttttagttctaaagcagatgagcataaaactaatttacgtgattatctttttttataaatgcatcatagttaaataccctgtatcaaaaaatttctattttattgattttaatacattcttttatcttgcttaaatactaattataaaagtcatcactattgatgactttttcacatatatttttaaatctattaaaattaaatttagatttcaagttctaattattcattaataatttcatgcattacttgtggaatcaaatcaattaatttactaggtaatactgtataagaattatcccctattacatccccacagctgccatgtagataagttcctaaaatagctgcatttttaggtgtatagccttgtccaacaaaactaacgatcatcccagctaaaacatctcccattccagccgtagccatcgccttattagctgtaatattacgatatgtctctcgaccatctgtaattaatgtgttaggaccctttaaaacaacagtaacaccatattttcgagcaaaaccaccaactttatcaatcatatctaattcatcatcataagcacacaaacgcttaaattcaccaaaatgaggtgttaagataataggaacggggcactcttttaataaatctaaatgtttagctgcaatcgtcaaaccatcagcatcaattacgattggacaattggcatattgtaaagtatcaattacatactgctcgctttgttcatttaaccctaaacctgaaccaatcaaaattgcatcacggtcataaaaaagttcttgttccagtttactattacgaagtttagaagtacattcaggagtaactattgctagcgcatcaattactttttcacttgaacaaacacatacaacaccacttccactataaaccgaggcttttgacgctaataaagcagctcctcgatagtaatcacatccagttaaatgtaaaatcttgccatagattcctttatgtccataataagcacgcggttttaaatgatatttgatccatgatggactaaccaatttagcaagcccctgctcctgacgtaaatctttagcatccaatatttcaactgcaatctctcctgtatacatatgacactcttcatttaaaaaagcctgtttgattgctgttaaagtaattgtcttactagcacaaatcacattaccataaggtattcctgtatcaggatttaatccagttggaatatcaattgcgatgatgtctatatcatataaattattaatttcttcaattaatatcctagctactccacgaacttcaccatttaatccgaaaccaaacattgcatcaattaccacatctgctttttgtgcatcacttataaataaagatatatcttcttcatccataaaagtaattggaacttccatctcttgcgcttgctcaatataaaaattatttgcttgagaaaatttattagggtttccaaaacagtataacttcacatttcgtgctcgaatatgtagtttaatccctaaacttaaaccatcagctccattatttcccggtccacaaacaatcacgatattattataacccaaacaatgcggtaaaatggcattactagctttatccactagttcttcgattgaatatccctcatttaataaagcctgatcgtaagccttcatttgtctacttgttgcaacatacatattatcaccattactttctctataaaatcttatgtttatattataaagcaattattcataaaaacctacttagaagcaaaaaaaataaaaaaagcagatttctacactctgcttctaggacgctcatccattatctcttgataaatcattgtaacaatattatgtggattaatattttggtctaacagacgttccagcatgatcatcatttttccatcattaatagtaccgataatattcgctttttcaatattttgaatatcacatatatatggaaaaaattcattgatttttgtattgattccataatgatgattagaacggctatataaataaattatcttatcaccattacaatcctcaaaaacacttccgcgaggataattaaaaacatttttatactgcttaacttgctttcttttttgttcatgcttatattttcgtttattttcatatactatttcaatatgttttggtgatagcatattaaccagctcataagattttttacaatcaaatataatcgtttcactgtaatcaaattcatatcgtaatgctgcttcacgaacaaacttagtcttattaacatataagtttgaattatctgtttgataaatataatataattgatcacccactctaataatatcaccaacgcaataaataatcggaacatcaaaatgaatcaatccctctaggtagcgtgaattaacaatcagttttcgctcaatcattattaaattattaattccaatccgattgtaaatatctcgaaaattagttcgcggaatcttataagtgtttgttaaatagacatatgtatttttacgatggtcatatatattcttatcaagcttaaatgtagctaaataacgggacttttgttttgtagaacaataatacccataaaaataattttcgtccttagcaacgaccaaatagggcctaattcgatgactttcttctatacgttctaactcatcattacttaacggcatcaaagcccatactagatttcctatcgccacttcattatatttatcttcaacaattggcgtaagatctataatttcctctttttctagtctactaaaatactttaataatcttttaaacaatttcatcttcccaccccaagataattatatacccaacaatcaaagaatacaaaaagattatagaagcattaatcctataatctttttgttactcattatataattgaaaaaacgaactgaagtgaggggtacagttcgttctttctatatttatatcttatttttcagcaattgttgcataattagcaacaatgtaatctacaactggattacttccccaagttttaatagctgaagctgttgcttgaatcgtatttgcagttactgttaatttataattagcatcatcatatccgtacttacctttttcggtagttgtaatttctttttttgttccattttcatcagttgttacaaccgtagtaacactcttatcagttacatctaatagtggatttaaagtaacgttatctaataataaagctgaactattaccgcctttgattgctcccatataataataagttccttcatattcaacccatttacctgcttgtgccgccaactctatatcatcagtatatttcacaacatttggcaatgccaataaagccgcattttgtgttaaaccattttcatcagtaaatgtattgcttaaagtttcatcaccgcgggtccatgactctgttaatgttgctttaacaactacatcaacattaccactgttttttactgttacatctttatttacttcaactcctggtaaccaatcagttggtggagtaaattcttcttcaattgtagtatcatattttgctgttttaaattcatttgtttttgtcaattcctgactaaaatacgctaacgacccaactactcctactgttaatgctaataataatattccacctaaactttttttatttttcattcttcttcacctttccttttctttattgttgttcagcaatcgtagcaaaatgatcggctaaatacacagccatcacattatcaccaaacgcatccctaattgctgcttttgaagcttggactgtccgcgcttcaactgtcaaagtataatctgcgctatcatatccatattttccgtattgatattttttagttacagttgtagtcccttgttcatctgcttcaacgactgtatgactgccgctaactgttgcatctaataacggattcatcttcacactatttaataatccatttgatgcttcatcttcaccaattacacctaaatagtagtaataatcaccataatgaatccatttattatgataatctgctagattatctttaacatcttcatattcataaaccatattttgaacaaaatttttaattgccgcatcatgtgaaatgccgttttcatcaacgaatgaatttggtaaaatttcaccttcctcgctcaagattttatctggatcattaggatccatcagattttcactacgtttccatagctcagttaattttgctcttaccacaatatcaacgtttccagtatttttaactgtaacttttttattaatttcaacacctggtgcccacttatcagttggaataaattcttcttcgatcgttgtatcatactttgccgtcttaagtctattttcaacagttaagtctctagaaaagtaagccaatgtacctacaaccaatacaattgcagctaatgaaataagggcagataggcttttcttatttttcatttctatcactcactttctttttaatctaataatgcatacgtttcaggaactacagtttcaaaagcggttcctgcgactgcttgtttattagcttgataaacttgaactgtaatcgttaaagtatagttggcactagcatacttaccattaccagttacaactgttttattgtaagttgcattattgggaatgcctgtatttggggcaactgcccatcctgtttcaggattattagttattttgcttggttcaccagttgtcatcgtcgaataatatactactgttttcttagtttcagcaaaatcgacatctccacttaacatgattgattttaaaaacttatcctcggctctaccacccgaagaaattattccgtcataatagaaatatccatcactatttgaatatatccatttattaccatattctttttcaacaacactagctcttggatcagcacttgtaactgtaatatcttcaccaacagctgttttccatgtttcactccacattgctcgagaaacaatattaccagttccagtattttcaacacctacttctttagtaactttatctccgggttcccaattatcttttggtgtaaatttttccacaacttctgacttaaactgtccagtttttaatttgttatcaacattcgttgtgctattataataagcaactgccccacctataactaaaaatgctgataacgaaataattgcaatcaaactcttttttcgtttcataattttcgtacccctttctcaaatatttaataaccgatatgtggtattaataaccaacaaatatacttttgtcatattacaacattattataaataatcatggtttgcttctggttatatttcactttccttaatattctattttaatgtttttattgaatctaaaaatcaataattgtcttaacttataaagaaaaacactctaacaattgttagagtgttcgtggcttcattagttgtttactgtaggtaatccatttaagaaattttttacagtttgatttgttgcatcagtgatccaagttgcagcagcttctttattagcttgtgaaacttgagcagtaattgttaatgtatactcagcgttatcatataaaccatttgatttaacttcagcacgtttaaatgtcgctttaatattgttattttcatcatctaatgctttaaattcttcttcagaaatttttacccattgagtttttgagtcagttccaattgatgttttatccggttcagttgctgcagttgtataataaaagtttttaatatctgttccaactacatcagcactattttttaaagtaattgaagttaggaaattttctgtatgtccatttactccaatcatctcattataatatgcccatccatcattaccgtcaacccatttatcgctcataccatttttatcaacaacactttcattattagtgtctggataagctactgctttaaattcttctccgttgcgtgtccatgattcttcccatttagcacgtgctactaaagcataatctcctgtattatcaactcgtacctcttttgtaacagttgctcctggattaaattctttaggtgtaaatttttcgacaatatcagagccaaacccttttgtttttaatttattgtcaactgtatgtgtttgagtaaaatatgctagagttcctacaactaccaatgcccctgataatacaattgatgccactacgcttttcttgtttttcatgatttccactcctttttattttttatttcattttacaaatcaatgataacaattgatggtttgcttctggttatatttataactcttattctattaatataactatcgaagaaaacttttcttttacaattaacagtatatctttatttggtttttttccggttatattcacaaacgaaaaataatattcaaaaacaaaaagagatgtataaaaatacatctctttcacgatttaatcaatagaaactaattgtccattttcaacaataattgaatcccaattttgcgtagcaactgcattagcaccgtcatctgcttgtacaccattagcagtgattataatcttagatttaagattagcatatgacattgtttcctcatgtgaggtaaaattattttcaataataaatgatttaaataaattgacagtctcattagattttaatggcatctttagatagtaataagatttacccttttccccagtagctttatatatccatttatcttcatcaattccacgaattacaattttatcaggatctttatcactcaagatatttccatcttcatccatccataccttttcaaccgtcactcttatgaaagcatctagttcctcagtattttttatatcaacaattttagatttttcttgtccaatcactactggatcatcatacttaattccatcttcactcacagaggcatcgggattagttgagctttcgataacatctattccaaattcaccaattctaatccggttcttagtctcatcactatctgtaaaccatgccagtgtggcggatacagcaagtacacaacctagcaaaactattagactcattatggttcttttctttttactcatctcgctacactcctatctttagactgtcactttttctttttcatccgctacaaggttactcaaaacaatatttaataacaatattccaccaataattgctaccgcaatatattttgctgatgaagcaaagatcgttccaacaacagggaggcagaattctaatgtctttccggctacattttgatattctaccagatttgtatcattagttggatttgcatcgccttttgtaacaaaagtttgtgaaatttcgtttttcactatcactcggtgagtaactaatgtatcatcatctactcgaaatgtgattgcatcgttttctttaatatcctcaaaagaagcagctttgtaatagatcaaacttccaactggatatgtgggttccatacttccagataatacaactacaggcttgtagccaactaccataggagcaagtataagcactaatgctattatcactacataacataatattgataaatagctaaccactttcttaaatatcttcataacctgcctcctatcctagttattaaaaatcttctccagatttctgttgattactattacccttataatcactccatgttacattatttccagaaatagcagcagttttaccaaaggtgctttgtgccccttcagttgtagctttacatgattctaaattaaatgtaatttgatagattattcctgaataatccaccgcatgagtatcatttgaaacttgctccgataaaaccagactatccaaaatgatattagttgttgtattagcttttaatactttagtgtaatagaaatagccgtcatttccatccacccattcatcttgccaggcagatgtccatttcttttcaacactatcaacgtcaccatttacaaaatcaccattttgattgatccagctttgactgtaacttaccctgattaaagcatcaatttcaccactgttggcaaatttaacctttttatcaacggtttctcctggtaaaaattgtgaatcttgattaaatttttcaatcaattcaatctccggttcttgcgttgccattttgttttctacattgacggtactattatagtaagcacttgtatatccaatcgcaacaatcaaacatactgaagcaaagattaaagctaccttcgtctttttaatttttaaaaatttcactttatcttcacctccatttaattccaagtaattacattgttagaaataactttaaaatcacgaccaaagtttgcttgtactgctcgatggttaacactatcgtcatcactatactgtactgcttcactaacaaatttcaaagtataatctgctgtttgataaatttcggcataattgctatcaaatttaagactagttaaaactttagctgtcatttcattagctggaagaacttttttataataataccagccatcaccaccatcaaaccagtcattttgccatgcttcagtccagttcttattaacaacttcattgccatcaactaacccagaaataaccttgccatcagcatctttccaaaactccgcataagaaactcttagaaagactggtgctgttccagtatttttgaattgtacttctttttctacttgatcaaaccagtctacagttgaatctttgtcaaacttttctactacttcagtatccactgttggtgtcttaatattattagtgacagatgcacttagttttgaccatgcgtagattccgcccactgcagtaagacagactgtcaccactaccatcaataccatcaatggtcgtttcattttaattctacctaaatatttcattgcgtcatccctcaccttctttattaattaccaactttttttatttctgcagcttctaaatcagtagttacaccatccttataaccttgcacagttaactgtggttctcctgcatcagccacaatatttctaaatttaattccttcaattacaaattttccagtagtttcatcaataatatctttccattcaatataagcattagtaccactgccacctagcttaccaccttgagcatcaattacctcaaacttattagcatcatattttactcgaatatcaacatcggtatccattgttgtaatacttgtaaaaatactattaaatgcattttccatcgcactactgttatttgcttttgtataatgtccttcactagctaaacgcgttaagaaactatcaaataatgatgaattattggaattaagaccaatcgtaaaaatcgtcttacctaaacctttaccagaacgattagttctattgcctgcatcattagaattattgttactacgatttttagtaatatcatcatttttatgaccataatactttgatccattactactttcaatgtaattattgattcctgttaaatttccactaaacttaataaaatcagcttgatttaaagcctcagctccaacccgatacccattatcatcataatcattataactagtattaaatcccttatttcctggttgaccgtcagtaaagacgattactgaacgattattttctccagttgcacttgataattgattacgaacttcatacaaacctaaatcaatttgcgttcctcctgaagctttaatatttttgataccaccattatttttagttaaatatgtgtaccatgtttcattacctgatttaatatctgataacttcacaaaattattattagtgatcgaaccatctgcactatatgcaaaagtaattactgatacacgactgtcaggattatgttcatataacttagttataaatttaattacattattttttaaatgggttagacgactgctgccattcattgactcatccatgctgcctgatttatctaatagcaagacaacgtcttgtggggcttttactgtcgtagatttaacatttccacttacattatattcatagttattgattgtttcacttccagcaggaagataattagtcttttcatcagtcgctttaaagaatccaacatgaccaaatgaatttgttagagtcacataaccattagctgcatctttattttgactaagttcgataatatttccactagataagtttgtttgagcataaccactttctgtactttctagcttatattccattggaacagtttctgttacggtatatttaccaaacggtaaattttctaaaagaacttcttcattattttttaagattaaatctgttttataaattactgcattttcactatctcgaccaaccacatgaataataaatgtcttatcttcactagaattgtttacaaccttttttacagtaagagttgcacttgtaattggcaattcttcattaactgttggtacattgaaatccaatgtagaatctttatcaatataatttttatagactaactgggttgggtcattggctggataatctgtaccatccttatattcctctttaactgctacataatattctaaatgagcttgactgtttttttcaacatcacctacataccaagtgattttttttcgaccattttctgtacttacaataacataaccacgatcaaatattaatttatcagctacagagttatcataacggccatcaggtaaatctaaaagatcaacatactggctcattggatcattgacaatcccattttttatgattgtttcatatcgagtcacaatctcattagcaatattttcataaattccgcttaaatcactagaggaactataggcatatccttcaccttgagtagctacattcttcaagaaactattaacactacttccagttgtgtaaccaatcgtaaaaattgtatttccacttttctttgctaataatgcttcattttcagctaatgtagcagctgcattatttaaagaatagtgactattatttaaatataagtctaatgtaaaatcatttcttccgcccttaattacactatcataattgattgcattttccccaaaagtatatctaccactatatcctaaagctttatcagtagcggtcgcttcgctataatcattaactaaataaccattattgcgttcattatttagtttataacttcctgtcgcaccaccatcacttaataaaataataattccattttctgatttagcattttttaaaacagttctagctttataaagccctgcttgaatgttggttccaccatccgaattatttcctaattcgacatctctaattgcttgttttgcggtttcaagattgcttgttagattttgttctactgtaccatagtaattaaatgtcacaattgaatatcgattctttttatttccagaaattttactattattcaaaaactcaattgcagcgtttttagctttagtaagacgttttttatcatttgaagatgtgctatttccatgttcatcttcagccatactatttgaaatatcaaatactagaacaatatcattaccaatcgcctcaacactatcctgggcttttccagtagctaaatccaaattgattttataccgattatcgccaactctttctgaagttttattaacagtaactaggccatcactactagtagtagagccagggttattttccgcttcaacaattaagttagttccagccgctggtattatcatcgctaatgccaaaaccagtgtttttatctttctagtaaacttattttgttttctttttttagatatcttcatttagcttcctcctcactgacgttactgttaagcttcttttttgttaccagattaacgattatataaatcaacactagaccagccaaaattatttttgcaatcattgattggatcattccataaatatatcctatataaggaatatttatctttactatcccatttaatcgactaaaggcaactgggtttgaatcttggctactattagcatcacccttagtaataaatacttgtttttcttggtctattttaattactcggtgagttatcacattaccgcttacacctgagcctttaaaacttataatatcatttacctttatttcatcagctttagctggtttaactagtaataattctccagttgaataaacaggctccatactattcgataatacaacatttacctcataccccagcaatcttgggccaagtgttataatcaaatatataaagcataagatcaataatatcgttgaaacaatattattaatttttcttattttattcacttgcttgtttccttttaagaataaagataccagcagcaattaacagtaaaacaattccacctgtaatatacaaataagtataattaattccttcttcacctttttttaaaggcgtctgatcatcaggaacttcctctgttccatccccaggtgataacggagtttctgaatcagtcacattttcggtatcatcaccttggttagttgtagtaccaccagttcctgctccaccagttgcagttgatactgcagtgttagcaggtaaacctacaggaatcactacaacactttcaacatattcctgtgttacatttaaatctcgatatacatatgtgattgaattatctgtttcaccaattgtaattgataaatcagcagctccaatcaattcatagccagcaatcgttttagctctctcgttcactgtactgccaagtggcgctgtcataacttttgttgtggctatttgaacattatcctgattaacataattgatcgaatattcgcgtccattagtcaaaacttgatatttggctacaaatgtcattgcaccagtaacagcctcaccactagctggaagggttttattccatcccattaaataatagccatcttctacattgatatcagggatatccggaaaacattcgtttgctgctacatcgatagtaatcttattttcaccattagcagcaaatgtaccatgagctcctgccctaaatgttactttataggttctactagcatcaactgtcattggattaacaaagccgaccattgcaatcatcatagctagaacaataatgacttttttaattttcttcatgactgcaatcctccttatgctttttcttcttcaataagaatataactgcaaatccactaactgctaccaatccaagtaatggtgcaattacagttgcatcaccagttttgatactttcataaacatttctaactacttcaacaatagtactttgatcatcaagttcttcaacactaaaattaaacttgatcaatccttcacgattttgatacgtattatccattgaatcaccattaacttccaatgtcattgttactgtagtagtttcacctttttgtaaactagcaagtaacgtatcttcactcattcttccagaacttaaagcagccagatcatcaagtgttccattataaaactcttcaccttcattagtaattgtaatattataaacacttaatcccgaagtatcagtatcaagactatctaagacatcagcactcaaataaaatcttaactctcgatgatcatcattttttaaaacaatattttgtgttcgaacttcaccaggcataatatttttaaaattatcaaataaatcctgactaccatccaaaaaaataaagtcttctgcatcaccatcaaatgatacattagtatcagctgcatgaatagtagtcatagatagtgctagtactgttgttacaactaatgtttttaaaatatttttacctcgcattttaatgacctcctccacgactattcttctacatactgaataacatcattattatcaattttaacttctaagccccattcactcaaaattgcagattcagcaccaactttttgaattgcttcagcttcaaaacttaaatgagcacttaaaccagagtaacgcattgcattagtgttatcgatattgccagataatttgatttgattaacaaataaatctgttactgcccctggttctaataattttttataatagaaataaacaacttctttattttcatcactatcttgaataatccaattatctttatcattagtaatgatttcaataaaaccaggattagcatcgatcaccttattaccgctttcatcttcccagtatttggtaacagcaattcttgtatataaatcattttctgatgtattttttacaaatgtttgtttatcttttatagctccaggataaccaaaattaaagttaataccttcatccgttatttgaccatcttcatttgttgtagcatctctcaattcaattccaatattccctgaactaagtttgttacttgaagaagtatcggcacggaaataggcaattgcgcctccaattggaaccatgatacatagaacaatcattaatattaatagcttattttttttattttccatgatgattatctcctttgctttaatattgatcggtggatacttttcccacattacatccatattatatgtaatggtggttttaaagcggttatattttgttttagataataactttcttttaaaatctaaaaaagagttaagttatatctctaaaacttaactctgaactgaagactctattggttttttatataataattttgcttttgcaacatcataattcaaacgatatgtagtactattatattttgcataaaactttttatttattctttgaatgattgtatatgcattgtccatttcctgacacgctactaaaataatatattgtttcttattaattttagcaaacaagtcattcactcttaatgatgaagcaatcatttcttttaactggttcattacatgtacttgattttctattgtagttttagcattaagatcaaaaataatcaaaaaatatttcttattatctcgaagtgcattcttaagtaaaatttcatacatatgcttaaacatgtcatatccacagtaaaaccctcgataatcagcattattaataatcaaatcttcattaacattttcagtattaataatataatcttcttctatatcttctgtaatgacatcataaagctctttaaaccgcggtgataatcctgttcccaactctttataaaagcgttcattcaggtcatcataatattttaacgcattatgatagtcctttaattcaatcaggcctttaatataataataatgtagaccttcgtaaaatggttctaatagaatagcatgataatttattgacatcatcttttcaaactgttttcttttcatgtagtatttgcaaattttgataacacagttaacatatgctgagcgaaaaaattctagcatctgttcaatccaaatagaatgattagtcgttatatataatttacctttatatagatgatttactttttgagcatatgctaggtccttatcacttatatcatcaatatattttattttgtcccagttataataaaactcctcagtatccatcacccattccaacttgggattgatttgataaccacctttaacagttaaaataacttcttcatcctcattaaaaatacctgatgcttttaaatctttacgaagtctaaaaatagaaaacttaaccacactatttggattttcactatccggatataaaatatcaataatattattcttagatattacaactcctttttgaagcagcaataattggaataaattaatcaactgttttcctaataatttggttaaatcaactgttacatttccacgtgaaagtgaaaacgttccaaacatatttacgttaatcttatcatttgccatatctaattccctcacttttcaagatatgttacttgcccacaaatttatccaccaaaatagtcatattctaaaaccccattacagtattagcccattatttttatttaatagtaatttattagtgataaattcttaccacttggtttaactatacgttttcgttcgcatataatcttactataaaacacgtaaatagacccaaatttatgtgttttttttgtgcacgaaaatctattctttcccgtgcaggaaaagtatgatcctcgattctaatttttttataaaaataacatattcattatagcactgtatttttaattacgtcaactttatttataagtgcggtaatactaattatattgatagaatcaaaaaagattacgaatttaaaatcgtaatctttaattagttgttatattcaatttttattttactcttacagcacaaacgaatcctgaaccagacacagatgaaatcttaactacatcaccagttcttggggcatgaatatattgaccattaccaatataaataccaacatgtcctgatttccataagatatctcctggctgtgcttgggaaatactaatttgtgtacctgcattcttttgagctgaagatgagtgtggaagtgaaattcctacacgtgagtaacaccatttgacaaaacctgaacagtcaaatgaatttggaccgtctgctccccatacatatggacaccctaatctagaataagcagctgataaaacactattaccatagttattacttgctgccccgccataaactgcatttacctttactgataagctcgcggtacctgtgttaccggctgcatcagttactgtatatgtagctgttttagtaccagctttcgctgtactaggagcatcaactttgacattggctttaacatcaccatctttgttatcaattgctgaagcaatatatgcattaaaatcaacattttcaccagcattaactgtaattgaagattttgttaaactaattacaggagctgataaatctttaacaacaacatttaagttagcctcactaacatttcctgaactatcagttgcagaaattttcaatgtttgcgtttcatcaatttttgaagtatcaatagatccttcaacagttggtactaaagtaccatctaagttatctgtaacatttacaaaattatttaaatcaaaaccacttccgtaatctacagtaacattttctccttgggttaaattaataaccggagcttctaaatcgctaacagcgaatgtaaaagttttaacagtttcattacctgaactatcagtagcctttaaagtaatatcttgttgacctttaacctctgtatttaatggggtattagcctcgataaatggagttacatcaccatcaacattatcattagccttaacatagctagcgaaatctgtacttccttttacaggaacatcaattgtgtatccttgatttgaacctaatgattcaaattttggtccctcattatctactacattaacttgaactgtttttgtagcaacattagaaccactatcagttgcagtaactgatactttataagaacctaattgtgttacatttaatgatgaagtgtcagctgatacttcaattaaatcacgactgtccttattatcagtaatatcaatactatctacatcaaatttctcaccataggcaagatcgatttgattagacttaatctcaggtttttctttgtctgctgctgcataaccaactagcataaaactagcaacagctgcaatcggaatgaacattgctttacgattaacgatatactcgtcaactacatttttaaagcttgtcttaatatttctatccattcgttacctcctttcaataatatatccaattgttattatattactattttttagaaaaatctagccctgaaagctctttcatttttgtcctttggctgtatcgcaagctccgcttagctttcaagagaataatttttttaagatttcttaagaaatttataagattttacatagtcctaaatagaaattaccataaacataaatattaataataatattatccagaatttataactaaaaataccttattcaatgctctttaatgactcaaccatatcaatattttttaaaacttttcgcattccaaaatcaattaaataagtaaagatcattgtaataattattgcataaacataactcattaaattaacacttctaataaacatagctacttcaacttctaccgcattaatgataaacatatgtaaaactttcccaattcctaatcctacaattgatccgattgctgataaaattaggttttctctaaatacataatcatacacctcacgtggataaaagcctaatacctttatagttgcaatttcacttttacgttcttgaatattaatatttgttagattatacaagacaataaaagctaaggccccggcacaagcaatcaatatcacaacaacactatcgatactgcccatttgatctctaaatgcttgactaattcctttaacataatttaatgaatcaatattgctatccttgtcgcaatagttagtaacagttttacgattgccatcatcttctaaattaaaatacgcataattattaactggtgtctcacctgttagacctcgataaaattcttcactcatatatatatggtgttgaaaatacaataacattactcctgtaattttaacctgataatctttttcatcaatcgttatatttattttatctccaatcgttactcctaataattctgataatttagctgaaataacaaccccctgattatttaatttaattttttcacctgtttgataattctctagatttgtatatttgctaagttcctcattattcttaaatacttctaatgtaccataatgatctttacttcctacaactgtgatcgtttttcgataaaaactactgcaatcttttacactacttaaactctcaaactcatccttttctttttttaattgatcattacttagattacgatcaaatacaaccattccatcgtaagtaaaaatatcaccatattgcttatctgctaaagtagaaaccgaattcttgatcccaaatccagtaacaattaaagccgcacaaccagcaattcctataatcgacataaagaaacgctttttatacctaaaaatatttcgcatcgtaactttttgattaaaagacaaacgtttccaaataaatgttattctttctagaacaattctttttcccattttaggggccttaggtctaagcagactagctggcatctcacttaattcttgacgtgtcactatgtaagtaactaataaagtaatcgctactgaaatcaaaaatgtttggatacaaataaaagtatcaaatgaaatcttgattggtgcaccgacattaaacaacattttacgatacaagaaataaataatacttgggaagaaatatactcctgcgataattcctaatacactagccacgaaagtagctaaaaaagcataaatcaaatattgattaattacatcttttttatcatatcctaaagctctgaaggttccgctttggactcgctgttcttcaaccattcgagtcattgttgttaaactaactaatgcagcgaccaagaaaaagatcagtggaaagactactgcaatggctttcattgattgacaagcagaatcatagcttaagatactagcactttcctcacgtgttaaactaatcagttttccagttggaatatcatcaatggcactgcgagcctcatccagttttatcttagcatcatctaacgatgttttcgcttcatctaatttaatctttgtttcatccagtaaaacttttgtcttgtctaatgtaattttagaatcgtccagttgttttttagaattagtcaaagttatcgctgtttcatctaactgggctttggagctgtctaaagtaactttcgtatttgctaacgtaattcttgcactttccaattgattagctgtagcagccaaaacagcaccattattgtccaattccagcttgctcgcatccaaagtttttttagttgcatccagttgaattttagtctcgttcaacttttcttgcattattgcagcatcttctggcgtaattaaattattctcaattaaatattgtaattgtactacactttgattatattgctcaattcccacattatactgattcagtccattattatattgatttatcccctcattatatgcactgattccttgatcatactgagcttttcccagctgataatcactgactccttgatcgtactgagcttttccatcttgatattgctttagaccattttgatattgacgatacccatcattgtatttatttaaaccatcttgatactgctttaagccactttcatattggctaagaccattgttatattgagctaatccatcttggtattcattgataccatcattatattcctgttcgcctttttctaattcacgattagcatcacccgctaattcctcattgacctgagcaactttaccactaagaacttttttaatttctttattaacatcttttacataacttaaataatcatcactaaaaatattattatcatcactgttttttaaagtcactcgaatttcattaaaaacagttccattacgaagatcatatagatcttgcggtaaagctaatgattcattgccttgagctaaaatttcaacaaaagcctcattagttccatcaccgagagtatttgtcccccgttcaatcgtactaaaataacgaggatcattgatcaatccaacaaccttaaatttcttttcaccattatcattagttaatgttatcttacttcctactttgattttatttcttgaagcataattattatccaccaaacattcatcatcagcaactggaactgtaccatcaactaattcaattttattgaccttattatcaaaactctcatttgtatatactgtcgttcctttgacattatcaccaacttggatcaaagcatcaaagcgatttccatattcaacctgagcgacttgctcaatttttttaacagcttctatatcctcatttgtaaatcctagtgttgcaacgtaattaagatcattgaaagcgtgttcttgaagataactatccatcgttatttccataattgaagccgtatgccggagtcctgcaaaaaaggcagcacctaaaaagacaatacaaaaaatcgacaaaaaacgtgctttagttttttttattatttgaatttgattttttacatatgctctctttttcatattaccactcaatttccgcgattgacttaggatgttcgtttatattcattgaagctacttgaccatttttaagatgaatgattcgatctgccattggagctaaagcactattatgagtaataacaattactgtcattgtatatttatcgcacatctcccgtagtaatcctaaaatcgctttaccggtttgataatctaatgctcctgtcggttcatcacataaaagcagtttaggatttttagcaattgctcgcgcaatagccacccgctgctgctcaccacctgataactgagccggaaaattatctaaccgtttatttaatcctacacgttccaaaaccattctcacatctaaaggattcttcgatatctgggtagctaattcaacattttctaaagccgtcagattttgaaccaaattataaaattgaaaaacaaaaccaatgtcatctcgtcgatattgcgtcaactgtctttcactatatttagcaacatcttgaccatcaactaaaatttgcccacttgttgctttatccattccccctaaaagattcaaaatagttgtttttccagcaccagaaggcccaacaattactacaaattcacctttattaacttcaaaatcaacaccatctgatgcattgatttcgacatcaccaactttatatgtctttttaacattattaaatgtaatgaaacttttcatttatcatcactacctttctaattaaaacatatacataattatatcacgaaactattctcaatccaatttctacttttttaataaataaattaaataatgctactcatattacaagaattttcataaaaatcgtgctaaaattaaatcaattaggaggtctattatgaaaataatgattttatcagattctcattctgtttctaaaaccgatttattaacccttttaaaaaacaactctgttaactattacattcactgcggtgatatttatatgacttatgatggcatcaatcttaatagtttttatttagtccgtggtaataacgattttggtaatattcctgatgaattatttattacaatcgatgatttaaaattttatattgtccatggtcatcgctatgatgttgattataacctagattatttaacccatatcgcaaaagaaaagggagctgatatagtttgtttcgggcacactcatcgaccttattacgattttcatgaaggaatcacttttattaatcctggtagtgtttgttatcctagaggtcagtatcgtaatccaacttattgtatttttgatactaagacaaaaaaaagtactttttatgatgtcacgacattagaaccatgtgaccctttttccccaatggaacgtcctaaaagaaaagaaccattttataaaaaatggttcaaataatcggttccggcaaaactttttggtacatgagcgtacaaataatcatacaaactagcattgggataatttgaatcaataacaatccccccactagataaaaattaatcaatcctaaactatacaatttaattaaaataattatttgatacaacaaaggaataacaataattaaaccatagaagataatcatttccaaatcgattatcttttttaaatcttttagatcataccccatatgatacaagttaagaaagctcctttttcgtccttgcaattccattcctactttaaaaatagttgtaatcgataacaataccatgacactaaaatatgacatcaacgtaaccatactaatcaatggggtatctaaagtataaatagttgtacacatcaaaataatcgctgctatggttattactaaaacaagcattctaactttttctagatcatagcgaacatttcccagcgtaattaataaacagcggtcttctaacgattcattagtttgccgattttcaatgaattcaggaattatattcttaactaggccataaacaccaattattccaataagagcaatcaataaatgactagctgtatcattaagaaaaggaaatacgatcattggtaaaataaacaaaacaagatatattcgatttgatagtttctttacgcctattccaaatttttcaattttaacatttgcagtcaccatcttattgatgctggtacgataacaatatcccatatttaaaagcgtacaccagccaatttcacaaaataaaatgatagcagttgccataaaagtattactcgaaatataatttaaacttccttgataatcaaagaccataaaaagtaaattatttactaaaggaactagaggataactaatgacaaaaccaattggaatagctaaaaacatgataatcgtactctgtaaaagcaaataaatcccaacttgataaacagatgcccctgacatcaaaacaattgacacatctttagttttcgctaaaacataaaaatcattagccataaatacacaaaccattgcaatcaaaattacaaaagcagctatcgtagtaatcaactttgcatcattcccaccaagattgatccctgtactaggattaagtgtaagattaaagaataaaaaaataaaaatcgttgttaaaacaaaagatagaaaataaaataaactctttaaaaaatcagtttttaaagatcttattgctaattttattaagcccattagtcaaacaacgcttgcgattctgtcgaattaatatcaacgattttgtaaaaatactctttttgactcatatcttttcgctctattgtttcatcaatcacaccatctttaatatataataatttcgatgaatacgaagcaattttagaatcatgagttaccattaaaatagatacaccgtcattaatatttaaatctctaaacaacgataacaattcatgagaatttttactatcaagatttccagttggttcatcagctacaataatctttggattagtaactaaagcccgacaaattgctgccctttgtctttgtcccccagaacactcacttggatatttattcaaaatctgctcgacatctaaccgttttgcaatctttgcaactgctgcttttatctctacttttgattttcctgctaacgtcagcggtacagcaatattttcaaaaatcgttagtgaatctaataaattaaattcttgaaaaataaatcctaaattttcatatctgaatttaccaatttctccctccgacatttgtcgtacctctttaccattaatataaacaaaacctttagttggaatatcgattgttgataaattgttaataaaagtcgatttaccagctcctgaaggacccatgacacaaacaaattctccctcatacatttctaaagaaacatcacttaacgcagtataggggttttttgtccctacaccatatatttttgttacatttttagcaactaaaattttattttccatcattttttcctccatgaatcggtgctaccaccgcttttttataattatagtaagtaattaaacctgaacaaacaacaggaataaagtagaccccaattactcctaacgcaaaagcaaccgacatctccccatgataaataaaacatcctgaaataataattatataaatcattggaattaataataaaactaaataaaaataaaatacctcatacttaattattttagttatttcttttcgtgtatacccaatcttccaaagattaaaaaataaagtttttcttgtctgggcctccatacaaaatttataaacgatactagttattaacaaaatgattattacaatgtaaccaatcactccagtaatatattcacgaggtgctccctgattagcagcgattgccgcaatcatccctgtaacagaaatcatcattaaactaattagtaaaatagctcgctgaattgaataaccaaggttagaaacataaatcaatgcatatctcttttctaataatttcttttctttaaacttcttaatatactctggcagcgcatatctaatcaaaccaatagccccaacgatccctaccccggtaggtgcgatataagcggtagcactatgctcattcataaacatcataactattccaaatacatataaaaataaataaacagctgatggaattactaatttacgtttatcactaaaatccattgccttttcttgttgtaacaaacttgaaatatcatttcgataaatatacccactagcaaaaacacaaagtgcaactaggatcattgcaactacaactatggtctgcataaatgctgctgaaggtatatgataaatcgatgcctcaatccccaaataatgaaacatccaataatttgagattggtgtaactgccatccccaacgcaagaccaattggtgctgcaatcagtaataatacaaatgtctgataaatcaaatatttagtagatttaaaagaactgtttcccgataatgtcataatggcaatttcattagtttttcgagaaataaaaaagctatttgcaaagaaaatcataaaacaacaaaagcaaattatgataaaagataatgttgtagaaagcggtacattgacttgattccatgtagtaccaccaacgacagcaccaggatcagctaataagtcgttattcataatattaaaaaagataaagcaaactgcaatagcaaaaaccattgtcaaagcataaaaagcactctttttatactctttcaccagtaatgtcattgcaaacttaaaatttcccatacttttctcctatctaagttttaaaaacttgattaattttattgatcaatttaaaaaaattagtcatttctgtttcatctaaacatttagaaaataattgcactaattcctcttgtacctttctagtctgaactatcatatctttaccatgatctgtgattataacattggttattcgtcgatcagattcgcacgctttaaccttaacaagactacggccatgcattcgtgcaactattcctactgttgtagcatgtgagacatcaaattccatactaatatctttttgattgatcgttcgatcctgattatcggctaaaaaaatcaggacactaagctgtgtaaaagttaatccatatggctttaaacgagcatttgcataattagcaatatttcctgccagtttatttaaactgaacattacttcataatccttcatttccgcctccctaatatgtagcctgctacatattaatattataagatgactaatattaatagtcaattaaaatatgtagtaagctacatattctaattgactaaaaaaactataccttagtatagttttaatattcattcagctcttttttcaaatcttcaatatatctttcttcaaatttatctacacgaacaaattttcctaatatcgattgaggttcaaaatcaaaatttagatacatgcgacatccaccatcaggcaaaggggcaaattgtccgctccaatgaccacgataactattattttcaacatcatagtcaaattgaatattttcacgtaaatctgtaacaaaaatcttcgtttcccgctgttttcgatcatattcaataaatcgattatcaccaatctgctcaacccgtgttaaatcactacgccatgaacaatcctttaaattagttattactttaaaaactgctgctacttcacttttaaaatcaactgtcatatctattcttttcattttttgagccctccacgattccattataacacaataaaaaaagagaaagcgaactttctctaaataattattttgctaatgctttttttgctgtatttacaattgcagtaaatcctttaggatcacaaattgcgatttcagataacattttacggttaacttcaacgttagctaattttaatccgtgcattaattttgaatatgagatatcatttaatcttgcagcagcattgatacgtgcaatccataattttctcatatctctttttacttgtcttctatctctatatgaatatgctaatgaatgcataacttgttcatgagcagttttatataatgtatgttttgatccaaaatatcctttggctaattttaatactttttttcttctacgtcttgtagtaaatccaccttttactcttgccatttgtttcttcctcctatgtcaataattattttgctaatctagatttaattctcttgtagtctgatgcacttactaaagtagctttagctaagtgtttcttttgtttatgagttttattgtgagataaatgtgatacataagcatggctgcgttttaatttaccgctacctgttctttttaaacgttttttaagaccactatgtgatttcatttttggcatgatatattcctcctaaattattttttctttggtgcaattattgcagttagagttctaccttctagcttagctggtttttcaatttgaccaacttcagcacattcagctacgaagtcatcaataacttttttcccaagatccatatgagctaattgtcttcctctaaatctaattgcaattttaactttgttaccttcttctaaccatttcaatgttctttttaattttacatttttatcatgaacatcaatagttaccgataattgagtttcctttaaagcaaccactttagaattacgtttcatttctttagctttcttttgttgttcgaaacgatatttaccaaagtccataatacgacatactggtggtttaccgttaggggcaacacacactaaatcaagtcctgcaccataagcaatatcaattgcctggttacgacttttgacacctaattgatcaccattttgatcaatgactagtacttctttgaaacgaattttttcgtttactaactcatccggttgttttggttttctgttatcaaatctgctaataaaagccacctccattttagtagtttaaacaaaaagtgagcacactgagtacccacacattgacattaagatagtttatcttagcgacatttgcctatcgacataatcaatcaggcgagaagtaggcacttcttctttccactacttttcatttacttgagtatattatcattttatttaattaaagtcaacccatatttaaaagatttattcatcttcatctatttgtaaatatttaaagtatccaaacaccgaaaagactatcaatactattaatgcaaacatttcatcaccactaataatatatgtaatcccaataaaattattacttgtttttatgattatgtttaaatactttccattctacagcaattatatttattaataaatataaacttagccaaattcttaatattttcaatatcaagataccaccatttatttctcacttagcgaccgcttgccccctagttcttcttgtgtcaaattatactgcgcccacagcctcttgctactatagcatatcgactaaatagaagctagaaaatgccttgctacttatcataacaagacattatttaaacatttttttaaattcttctggtacaaccgctttaaattccattctagcttttgtatccggatgaacaaaggcgaatacatgactatgaagtcccattcgtttaatcggattagttgtagcaccatactttttatccccaacaatactatgacctaatgattgcatatggacccgaatctgatttttacgacccgtttcaagaaatacttcaatcaatgaattatatcgtgattcttttaatactttataatttgtaatcgccaatttacctttaccattattagcaatataaaccatttgtgtcttactttcatcaaggtgatttttaatcgttccatgcttctttttaagctttccttcaataattgccaaataaccacgcttataaacaatatcattccaattattttgtaatttatttttaattatttcatttttagcaaacaacagtacccccgatgtttctttatcaagtcgatgaacaataaaaacacgggcatttttatttttacttttaagatactctccaactaaatgataagctgttttttctttttcatttcctccggccatacttaataaaccagccggtttattaataacgatcagttctctgtcttcataaataatatctagacttgaattattattaggattacgatcaacaacaatctcatcatcccgttttaatgaataatcaaactgactaatcacttgcccgttgacagacacctgcttaaatttaagtaaatttttaacattctttttattatagtgatttaataaaaactccattaacgtagaatctgtcttcactaaatacttattcatcgattttttccgccttaactgccattccagaaacttgacactcaatcatattgttgccaaggtttgttgttgtaaagcgaacattaatgattgctgaagcatgtcttcgagaagcttgagcaactgtttctgccatcgcttcttgtcttgctgtatctaacatttcttcaatattagtattatcactagcaattgcctgattcatgattttactgctaaaaacgattcccagactctttgtaattcggtatccgggtaaataatcaatcgtacttacttcaatcatatccattatattttcctccttataagaaaaggttactaaagtaacctatttcatatcaatgattcgatgagtattaaataatacaactacaacttctattaaataaattactaatgccagccaccaaggaataataaataaaacagctaagatcattaagattacattaataaacaatcctacaaaaatattttcaatcgtaatatatttttgtttcttagaaatcatgaatgtttcaataacggtattaagatcagaattcatcagcataatatcactattttcaatcacttttttatctttgatgccaccacggctaatacctacataagctttttgcaataatgcaatatcttttgaattatcaccaatataagcaactggtccagcaatacttgctttatccattacttctaatttttcatcaactgtcaaattattatagattcgatactgatcattttcaagatcaactggtccatcattgaaaataatcaagccaacatgtaattttgataatttagcgaataattccatttcctcttcagttacttcaactccatcaaaacgatcataaataactgttcgacataaattcaaagcatctaaaccactattttctttaataacaatatttttagaaaaagctttagccactcctgatagaacagcaaaagaagaagcctgcttgtaagcaaaagaaccagaaattgttattaaaatagcccctaaataaatatatttaaaatttgcttcaaaattaagaattggcactaatgttgcacaaagaattcctgcgacgactaaaagaactgtatcaatcttactgattaattctaccagcctatgcgttcttgaagaaccaacaggtgccattgtcgcaatttctaagactctgctcattgcactgcgatcatacgtatataaaattttaattctcaaagtgtctttaacattgacacttccactttgaacttcacttccggctttaactggctctaaaatatctgatccattaatggcaaacatatctaattcactttcacccgaagcaatcttgccacctagaggtatcgtttctccaggtaaaactacgatcacatcaccaatatcaaaatcttctaaagaaaccatctcatattcattttcaccaatttctcgacgtcccaattgaattgggttgatctcgtcatcaattttctccatcgttaaattgattaaacgcatcaataaccgttctccaacttggtaaatcaaagaaaccacgatagcctcaatataagcaccataagcccatccaaataaacaagctagattaattgtaatattttcacttaagaattgtttaacttttaaatctttatatgcttgaaccaaggtcttttcattaaaaataatcaaagcaatcagccaggcaatattagttataaaattaggatcatcttttgtaactaatccaagtgctaaagctacaaataatcctgcaattctaatcattgtatttaaatatttttgttgaaaaatatcttgtgatttaaatggcttcttccattgctccacatcaattttaggattaactttatcaactagacgatttaatcgcactaaaatattcttttgactagttgtgactttaagtaacttattagtaaaatcaagactaacattttcataggctgaatatcgtgaaataacttcctcaatttcttttgcctcttcttctgtctctaaattagtaaacataaaaatatgttctactttttgttctggtgccacgaattcacgcttacgtgagttgatttcctcttttaaaacaagattttcatcatgattattcaaaaccgcctgcacattttcaggatcttcacaataaaatgaaatacctgtttttccaatcttgattcgtgaaacttcttccatttcgtttaagaggaggctgacctcatttaatttatcattatcatttatattatcaatatagaaattacgagccatagtaatctcctttccaatagtcacctaattttagcatatcttcaaaaaaattccaactctactcattaacaccataaactaactgtaaaatttgaggataataacgttcaaattgcaatgcatcaatttccgttggataagacattaaatgaaaatacagacgatgttttaagttacgcacaggtggtacaaaataatcatgctgatcatttagcactaagccatttctttgataaaacgcaatccgtcgacgactttgctcatcttctggatgttcaacttccaaaataaccggtttccctgccgtctccataaaatgttttaacatcttacttcccaaacctttgcctttttgattaccatctattgcaaaataatcaacaaaagcaaattctccaccatcataatgtgataaaatacctttaatttcatcatcttcttttaaagtcaaaactttaaaatcaccattaataaaagtctctttcatataatcatattctttgatttctttactaggaaaatttcctaaaataactttataaaaatcattaaattctgctaattttaaatcttcaaatatcattttctaacccccgtttttttatttattaaaacaaagttttcttcaaattcctctttagtacatgacaaatcaaactctttaccatatattttataatttacctgaagctgaccactatcacgaatcacacaatcgtaaacttggcccttagtaaatagatcccgctgttctttaccaattacaatattcattgtcttgatacaacgacacacgcgacgttttcctgtatttgcgatagtaatcacctcttttctcattcattataacatgataattaaaagaaaagtaagaattagccctgctaattcttactgaattccaataactctaaatcaggattcttctctgtagcccaacgaacgccccaatcattagtaaacaataataaatgttgtccttttaaatcttgtactttttttgtatcactagataaatttaaagcttttaaatcgcatccctctttaacccagcgcacatattgatatggtagcggctgcttgattatctcaacattatattcattctttaagcgatattctaatacttcgaattgaagtaccccaacgacaccaacaataatttcttccattccaccgcctaattcagtgaaaatttggattgctccctctttagcaatttgttctacacctttaacaaattgttttcttttcatcgtatctttattacgaatcaatgaaaaatgttctggagcaaaggtaggaataccttcaaaagcaaatttagctttacctgttgtaatcgtatctccaatcgaaaagatccctggatcaaaaactccgatgatatctccagcataagcttcatcaacttcttgacgttcatcagccatcaattgttttgactgattcaattttattttacgaccaccttgatagtgatatacttccatccctttagtaaatttaccagagcaaattctaaagaaagccattcgatcacgatgtgctttattcatattagcttgaatcttaaaaacaaaggcactgaaatcttcactaaatggatcgattgttttttcaccagtacttcgtggtaatggtggtgttgtcatttctaagaaatgttttaaaaatggttcgattccaaagttagtcaaagcagaaccaaagcatactggagaaagtttaccttgacgcactttttctaaatcaaaatcatttcctgccatatctaataactcaatatcttcctgcagcttattatataattcttcatctaattcattaattaattcaggatcatcatatttcattattttagtatcaacttctttacgcccgccatcaacagggataaaacggattacttcctgatcatgccgttcataaacacctttaaactgttttccagaaccaataggccagttaactggacaagtatcgatccccaattcttgttcgatctcttccattaaattatatggatcttgagcttcacggtccattttattgataaaagtaaaaattgggatattacgcatcgtacaaactttaaataatttacgagtttgatcttcgacccctttacttgcatcaataaccataactgcacaatcagctgccattaatgtacgataagtatcttcagagaaatcctgatgacctggtgtatctaaaatattaatacaaaaaccatcataattaaattgcaatacagatgatgttacagagattcctctttgcttttctatttccatccagtcacttgttgcatgtctgctgttcttttttccttttacggtacctgcctgttgaattgcccctccgtataataagaatttttctgttaatgttgtcttaccagcatcgggatgggagatgatggcaaacgttcttcttttttcaacttctttgataaaatcgctcatttttatatctccttgcaaggattaatcatatagatttataatgaatttgtcaaccgaaatctatttactcagactgtttaacggagtcttcgtaataatgaaagcaaagacagtgaagattacaaatccaccgattatcacaaacggataaactattaattttcccgattcaatcaataacggtaaaattgctaaggcaccagctggcggaaaatataatttagtaattttcataatgctcaacatgatcattacaattataattgcactaatagttaatggcaaatcaccaatctcacttatcaaaattcttccataagcaccactaaatgcacaaataaaggtaacaaatgctaatttaatcgaattatgacgcaactttgggtgattactactcaattcaacaaaagcaactatcaagggtggggcaatcaaaaacagtaattttaattgtaaagcaataaaagccgttaatgctaatgcacataaccgttttaaatttaagctataggtttctttaactgctgcagtaaccggatgatattcctgaacactacgatagccgcccttctctaaatattgttgcccgattacaatcaaaatactcattgcagtagcaaaaagcggatacaaccatgactcactattaataatgattggtaagatcgttgcagatatcaatggagcaaacgtcgttttagataaaaataatcccgtcacacatactacaaagccaattaaaattttaaaataaatatcaatatctacatatttaaccaaaataatccctaacgacgcataagccgcaattaaaaaaaccaatttaattttattagttttccatacttgtttaggcgctaaccatgctccaatcgtcaatgccgtaatttctggaaaaataaattctttttcatgaaacacttctgacatcaagatcattaaagctactagcaagatcgtcattatctggggaacaatacttttctttacttccatcattttcacctcaatagaactcattctattacaaaaagcgagtatagtaaataagaaaacgatataacctaaccgttatatcgtcatttcttaaaatacaaaatttccgttttcaaatatccttactacttgaccatcttttgtttctcccacaattttcaaatcactagtaccaatcataaaatcaacatgagttaatgaatcattgactcccttttccaacaattgttctttagtcattgttaaaccaccttgaatacattcactaaagccttttccaattgctaaatgacatgaagcattttcatcaaataaagtattatagaataatgttttcatattagaaattggcgaatcatatggtaccaaggcaatttcacccaaataaagactaccttcatcaatactcaacatctcttttaaaacctctttacccatttttgcatcaaaatcaataattcgaccatctttgaattccattttaaattcatcgatcaaattaccattataatttaatggcagagaactatacacaaccccattagtcccattacgatatggacttgtaaaaatctcctcggttggcatatttggaaaaaaatattgtcctttagtcgtataagaacccccaccagcaaataggtaaccctcatttaaggtaacagttaggtttgttccaagcgaattagtataagtcaatgtatttaaattcaatttatttaaatatgctactcgagcttcaaaacttttacgatgttcctgccaggcagtcaaagggtcatcatctacgactttaaccgctttaaaaatagcattccacaacgcctctactgcctcactatcagacatatcaggatatactttatttgcccatttaattgaactgccagcaacaatgcaccatgtatttatccccaaatcaaggctatcataaaatggtttacaagcagttgatacactttttgaccacaatgcgatctttgcaggatcgattcctttaaaaccttcaggatcatcactaataattgttaaaaaggcagcctttttagcagcataatcatttctaaattctttaaaccacgttggaacatgagcaaacgcttctttttcaagatatttatatttatatcgtgaaacaacttcatcattatattttacaaccacttccctagctccagccgcatatgcctccttagttactaaacgtactaattcaacactctcaacaggtgcatcgattacaacaatttgagctggctgaacatttaaaccagctttaacgatcaattgtgcatattttgataatttttctttaaacgacatctttatctacctctttccatcaatttattataatcaatctaaacttctttatacctctttatcgagcttattcaactcttcaatcgcctctttcattcctttattggcagcctgcttaaaatactctttggctttttgtttatcttgattaattccatctccataactatacatatagccaatcataaaactagcatcataatacccacgttcactagcctttaaaaacaatttaaaagctgaagctttatcaactgttgttccaataccataaaaataacaacgtgctaaattatatattcccggtacatattcatcacttgttgaagcaagatagtatttgaaagcttcatctaaatttttatatccaccaattccattttcaagatatattccatacatattcatagctggtccatagccttgattagcagcaatctgcaaataagtaaaagctttatctagatttttagcaattactttaccttcatctaaatataaagccatccgatacatagctcggacatcattttgatcaattgcagcttcataatatttgattgcctttaaatcatcatgatactgttcattatgctcatagatcaaacctaaattataaagggcaattccataatcttgatgacttgctaattcataatactcaattgctttatcaatatcaacatccactccattaccttcttcatatgccaaagctagatgataaagacccggagcataattagcttctgcagctttttgatataacttaaaagcttgatgatgatcaacatccactccttctccatgatcgtataagtaacctaaattacataaagcccgcggataacctgcatctccagccaagcgataatagcggacagcttcatttaagtcgacatctataccaattcccatttcataacaatatgctaaattacattgggctggagcatacccttgattagctgctttattatatagttcaattgctttgattaaattttgtttaactccaaaaccactttcataacagtaacctagtgctacgattgcctgaacatcattttgtttacttgcctgacgataccaatatgaacagcgatatggtgcatttttaatttcaggatgattctcataaaaataacccaaccaaaactgtgctcgcgaatatccttgacgtgcagcttttaaataattttgacgtgcagcttttaaatcaatatcagttccttgacctaattcgtagcacgacgctaacgcaattaaagcaggagcgtaattaacttgactagcttgataataccaataaaatgctttaacaaaatcttgaattgttcctaatccattttcataacaataacccagacggtgttgagaacgttcgtgcccttggttcgcagcttcttcgtaacatttgaaagcacgttcaatatcttgttcaattccttcaccaaattctaaacaagttcctaagctatacaaagcctcactataccctagtttagccgcctgataataataattaacagcacgtggaagatcaacagcagttccatgaccgtattcgtaacaatagcctaaattacaaatagcacgagcaaatccagctcgagccccaaattcatataactcaaaagctttctgataatcttgtttcacaccgattcctaactcatagaaatatgctaaattgcagcttgcgacaacatttcctaaacttgttgctgattgataataacgaaaagcctgataatgatcttgttcgacacctagtccacgttcatataaataaccaataatgcaaacacaatcactattatccacctctgctccctttttaaaatactctaaagcttcaagatattcatgtttatcaaataatttcaaacctaattcatacaataatttaccactgacattatttatattttgtaaacgatcaacttcatcaaccatcaaaagacataggtcaataccaattatctttccttgattatcctcaataagatattgttcataatctaaatattcactttcattgattacttgcaatcctaatctatttttaatctcttctacacgtttttctaaaaattcaatattattatcttgatcatataatgttattacttttaaaagagccgttttctcaacaccaatcgcttgatgtttaatttttatcaatgattcttgatcatgaatttctaccagttcttcaaacaaccattgattaaataacggctcataacttttaacacgatcttttatatccatacttacctcctttcgatagagaaataagcagatattgttatctgcttactgtccattaatcatatgagatatctcttttgaatactttcctaaaattgcactaaccttgttacttgtttgaacgattccagaagcaccaagtgcttttaacttatctaaatcaaccaaactatcatcatttacaaagaaagtgacttttgaagaagtagctgttgtttctttaatattcgtcttaccgccgacagcttcgataatactatttacatcaactggaatatcagcagctgatacttgctttggttgcttatttttcattacttttaggaaaataaacgctaatattacgattacaatcagtgcgattattccatataataaatattcattcattaaaatataccccctattaattaccatttaattatagtatactataccatgatagaaaaaactatcatttttataaggagggattttgtggaagaaaaagaaaaatccgttatctgttggccattaatcggtctattactattgctttgtttcattagctgtctgggaattaaaagcgccactcctttgattactaaaggaaatccaagtggctattggattaaacagctaatgttttatggaatatcatttatcttgatgtttatcgtttataaagtctccaacgatcgaatctattcatcgatgtggatcatttatggaattttaatggttttactagttggtcttgctattgatcactttgcatttacgcgatttggaatacatattgttcctttagctaaatgggcgggtggtgccacatcctggtacaatctcaaagtatttgatctccagccatcagagtttatgaaaatcatcatggtggttgtcatggcagatacagtcgataaacataataatcgctatttagtacataatattcataatgattgtttattgattggtaagctcttagctatttccttaccaccttgtatcctcgtttatttacaaaatgatgccggagtaacaatgatcatgcttgcatcagtagtattcgttatttttatgtccggtattcaagccggctggtttatcataggggggattgtagttgcaatcatccttgggattggagtttatctattcttataccaacatgatatttttgctagtttaatgggaggagaccataaattaaatcgtttctatggctgggtcgatcccgagggtacctataatgatcaaggtttccaactgtttaatgcaatgttatcatatggaactgccggcctatggggacatggtatgggaacagctatcattaatcttcctgaggcacaaacagactttattttcgctgttattgccttaggatttggatttgtcggtggcggtttcactattgcagttgtctgtgtacttgatgccttattaattagaattggttttaaatctaaaaataatcgggataaatatctcacagccggaatctttggtctacttatcttccagcaagtttggaatatcggaatggttttaggactatttccaattactggaatcaccttaccatttctatcctacggtggttcatcacttctttcatatatgattgcaatgggaattttcttagatatggaacgacaaacgcgaatcctcgaaggaaaaaagcgctattaacttattaattatataagatgatttattaaatgataaatcatctttttatttcgataaaaaagattccttcatttaatttcagctatttgctatccatttatgaggaatcattttaattcttttcaaattgttttgaatctttctttacttcaatcagacgttgtgtaaaagggtcaataaaacttaatgctatactatccaaatagtaagattcttgataaatcgaatcataaagtgtatccccaactaacggatgattgatactagataggtgaaccctaatttgatgagttcttcctgtttctaagatacactctattttactctgattagcacttacctccagtccccgataatgggttacagcaaatttcccagctggatgaatcagtcttttaacactttttttatctttaataattggcgctgtaatcgttccttgtcccgtcaatactccctctactacacagtgatagacacggcgtacctgcttgatatctctagacaataaataatgagcataactgtttttagctatcaacaataatccttgggtatctttatccaatcgattaaccaaatgaacagttgcctttattccctggctttgatagtaataaacaactgcattggctaaagtatttcgaggataacgctttgtaggaatacttggtaatcctgccggcttatcaattactaaaaaattttcatcttcatagcaaatttttaaagctagcggatatggttccatagtactaacttcttcaggccacaataattcaacaacatcaccgtaccgcaaacaatatcgtaccgtttgacgctgaccattaacaagaatcttcccatgcattttaattaatttaacagcttttttactaagctcctgttgactaagaaattctcttaacaacattccgctttctttcattgcgataataaatttcattcgctgataaaagcccttctaattcgttgaataaaagacatttccttatattctatgaactttactactttcttagaaattctaatttcaattttttcaacatcatcaagatgataagataagtgatcaattcccaaataaactcgattaaaatgctgtccttttaacttaatcaccttattttcatctaaaattaaactagcacccaaacttcgataagcattatgttgtatagcggcgacttctgtcagttgcattaagggatttcctggataaataacagctccaccaattgacttattataagccgtcgatcctgatggtgtagaaacacaaagaccatttcctctaaatacttccaaaagctcatcatcaatatagacatcaattacttgagttgtatacccatgatcaatgcgcatctcatttaatgctaaatatgtttctttacctgctttatgatacacatcaacttctaataaatgtcggggcgtcatttgataatgatcagcttttatagccgcaatcaattcagtaatttcatctttttgataatctgtaaaaaaaccaagggttcccgtatgaacacctacaaaactaactttttgctccatatattgatgcactgacaaaagcattgttccatcaccaccaacactaataaccaaatcaggatcatcgggattatattccataattccggttaaccctttcttaattttttcagcaatattagcagacatttcatcctgttttactactaatgcatattgtttcattgttttcaccaaccttagcgtatatactatagtatatactaatggaggctactatggaagaaaacttagaaatagaatttaaagtattgatcgacaaagaaatataccagcaaatctataacgatcaccacatcgaccatcaatatagtcaaactaattactatttgattcaccctaaattaactgaattaaaatatatgctgcgaatccgtcaaaaacaagagaattatgaattaaccttaaagcaaccacaatcatatggaaatttagaaactaatctaaagattgacaaaataactaaagagaaaatcattactcacgattttgttactaatgaaatttttgaccttctaaaaccccttggattagatagtacgatgtttaaaacagactgtgtacttactactacacgttgtgaaattaagactactgatggcttgatttgtctagatcaaagtctttataacggaattactgattatgaattagaatacgaagtatttgattatcatcatggtaaacaaatatttttagactttattggtcaatataatttaaagtattctcgtaattgtcctagcaaggtaaaacgtttaatggatagtttaaaagatgattaaataatcatcttttttactagaactaaaaaagcagcgtttcataacactgctatctatctttaaaataagcctctttaattgagcatggttcactaataaattgtggacaaacttcactacttggacattctgctaatttacgtaactcacgaggaataaatacccggatttcctctgcattataacctacctggaatcttcgctcatcaatcataattgggcgttttaaaactgatggattttcttgaataaacttgatcagctcactaattgacatgctatcaatgtcaatatcattttccttaatgattttacttcgcttagaaatgatatcgtctgttccattttcgcttcgttccaatagttcttttaattcaatttctctaagcaaggttgaaaaaatatttttttccacataaggaatattatgttctttcagccaagacttaacctttcgacatgatgcacaactcggtgctgtgtaaatacgaatcataataccatctcccttacttcactattatacattatttttattatttttctatcattttcgttaatcatagtaaaataatatgcaaatcgaggaacttggattaatcaagttcctcgatcattttaattacctctatttttgaaaaacctagtttcctcatttcttcaataaaaactttaactttatcaagtgaaacatctttttttaattcactgatcaaattactgtcttcactgacaaaacgtcctaaagctcgcctgctataaattattcccgttctttctaattcacttaaagctttttgaattgtattgggattaactccatattccaacgctagctctcttactgaagcaagcttacttcccggtaaatactcactggcaaaaatctctttttttatttcttccatgacctgaatataaattggtaaattaggatcgaagtcatttttcattctaccacctactctacttcaattttatgatcaattaaataaacagtgaagaaataaaatgctgttgctaatactaaatttaaaacaatgctaaaccaaacagaagcagtactatccaaactcattacaaagctctcaattggctgccacattaataagctgcttcctaaaattaaaagtgctacataaacaataattccaataacagttttgtgtttaggaatatatttagtctttgttaatgtaataatagcataaaatgataatatcattgaactaaccatcgcaattgaatcaattaaatttattactactaaaccaaaattattacctaaagcctttaacaactcaccaaataaatcaaataaagtattcaaaggaacattaccaattaaaaatacaataattaatattcccagtgataaaacaatcgaactaacaaacacccaaattaaactacctataaatttagccccaaccaatttttcagtacttacaggcaacgtcaaggttaaataaccaggtcgcttatacattgaacgattaaaatttgtaataacattgaccaaaactgcaattgatatacctaacattgcaaaaatcatcaatgaactcaatacttgactaataaaatctggcaacaacggtgccaaaacacataaaatcaaaaatattcctaaagttaaaaagtattgacgatacgattgaatcatctcatattttaataattttaacatctaaatacctccctaaaggcttcatcaattgactgttttctttctaatcttaaatcttctgttgattgatgcaaaacgatttcaccatcttttaaaaacacgacatcatcaaaaatagtttccaaatcactgattaaatgtgttgaaataagtaccagagcatcttcttcataattattcaaaataacatctagaataacttcacgagcagctggatcaacaccagctatcggttcatcaagaatatataatttagctttgcgtgacatcaccaatgatagttggaatttttctttcattcctttagacatctctttaattttcattcccttatctaatttaaaacgattcatcagagtcaaacaattttctttatcaaaatcttcatataaatcactgaaaatacttaagacatctttaatatacatccaatcttgaaaataattctcatccggtaaatatgaaataatttttcgtgaatcaattcctacatttttcccatcgactaatacttcaccttcataatctttcaataacccattaataattttaatcaatgttgtttttcctgatccattaggacctaataaaccaattattttaccagattctaatgtcatcgaaacattgtttaaagccttaaaatgatgatattttttggttacattagtaatctttaatagttcactcataactctcctcctactgtattaatacactaatacagtaacacgaatttatagtattgtcaatacaattattcttatgactcaaaacaaaataaaaagatttttctagttatttacatagaaaaatctttttatttattttttcacaaattcattataaagaagttcatgaataaaagaatatcccttttctaattttttctttagatgaagatatttaccaatacttttatcatcattgatttccaactgtttacaaacatttagaaatttatcatagtcttcaacatataattgatcaaccatgttttcaacatattgttttttaattcgttcattgcgtgttaagccatattctttgattaaaccctcatcatacatgtgataattgatctttactatcggtaatttttttaattcatgattaattaatgttcgctgtttcatcatcgttaatgaacgataaactaatttaccattattatttatttctacgactacactatatttcccatcaccaacaataaagatgttattaaaatattgactatcataaatattgatacagccataaataaaatcatgcaaagtcttctcatcaacatgataaatatctactcttgaaatgatttctagatcatcatcttcatcccattcatatggttctaataattcttcatcttctttaacccagtttacaattatatctttcatatcttcctcccatataaatatatgattattttataaaatcatgtttttagtatatttttatttttaattaatatataatgattcctgaggtgaaaacatggaattaattaaaaatatcatcatttatggtattcttggagcgattcaaggttttagtgaaccaattcccatatcaagtagcggccatttagttatttttcaaagtatttttgaaaaaatgggactaatggttcctcaaatgaacgatgttacttttgaagtaatcgtcaatactggatcactactcgcgatcatgtattattatcgccacgatattgttagattattcacagctttctttggctatattcgaaaaccaaaaaaaagaaactattacgaaggtgattttagatactgtattttattgattgttgcaactattccggcagcaattggaggatatttatttaatgataaaattgaagcagctttttctaaccctaaattagttggatgcatgttactggttacagcgattttcttattatcaatccataaatttggctacaaaggaaaacggacagcaaaaaaattaaacttattcgacgctttaagaatggggatttttcagttatttgcattacttccaggaatctctcgtagtggttctaccctaacaggaggaatgttagggggattatcacaaaaggcagctcgtgatttttcattttttatgttcatgcctgttagttttggagcaattattttaaaactaaaagactttttaacatccagcacacttggtgctttatggcttccttatttagttgcttttattataagtggaatcgttacatatttggctctacacttattatttaaattactagataaaaagaaattaaatgtcttttctttatattgtttagtagttggtattttagccgtattatttttgtaaaacagtttaaaatgaaatgtctctccattaaagttcatttcaaaaaactgttttttttactattaattttaattatatctgtaatattcatttctttaccatcaattttgattatttttttgtatagatcaaaggctgtaagtatatccttgagaattgcataattatcttgagcataataagcagtttcgatcatttattcacttctaagctacctaatcttccagtccaactcttctattgcatcaagagcaagctttttcgttcgataatgacccacaatttagccctgaacaattctttaaatccttttagtggatcataagataaaattattttacacgttcggccttttcatcacattgaactattctctttccaacatgctaaaaaccagttaatagctgatgatgaagttacaataaaaaaataccattgatttactttaatcacaagtaattcgatggttattgataaatactttgatcctcaccaaatcctagaattaccaataaagataattggcaaagttatttttactaaaaactattattaagtaagaattccatctctcactttttaatttgaacaattgcacaagctccattttcgttatttaataattttagaataccgccatgtttttcacaaaggatcttactaatcgataatccaattccaaaacttcctttattagtctgtgatgaataaaataatgtagttgcattttctaaatcctttttactaaaacccggcccatcatcctgaataacaaattcaagataacccacagtttccataatcgttaacttaaccccattattagcaaagcggaaagcgttatttaacaaattttctaatattttaaaaataatctgtttatcaagatataattgtttagacactatttttgcttctaatactaaatctttatgattattcttagcgataatcataaaatcattattaatttcttctagaaaatctttgccgacaaccattgtcttactaatttcaatatcttctattttttggatatcttgaatacattcaacatatcgctctaaacgagctgatgaatgagccatactttttaaggtcgttaataaaacatcatcagatactctcttttctggaagattttttaataaataatcaaggtatcccttcaatactgtaatcggggttcttaaatcatgtgatactgatgccgttaaagcttttcgctgatctaaaagttcccatactttttggttattttcaatcagttcattacgcattacctctaaagtactacataaccgacctaattcatcattagaattataagttatttgaaaatcaagattattattggttaaattagcgattcctatatttaattgttcaatcggcaacgccagttttaaacgatagtatatctttacaataaagattgtccctaaaacaagatataatgttggtaatgcgatcatcgctactgtcgcactaagataaataaatttatcttgattagccaattcactatactgatactcatcatttgagggcgagatttcatacgtacctgtaatattttcactaataatagcggtatctactgcaatatgaatagtccgattatcaagaatcatttgtcgtaatgatgaagtcaacaaaactgttgtagaagacaaaataataattaaaaataaagctacacttaatattaataataatgatttttttaaagacatgttataaaattgctgttttattttttccatcgataccctacgccccacactgtttctaagtattcattttcactataccgggataatttcattcggattttacgaatatgttctttaattacagcactatcaccattagcttcaaagccccatactacttcataaattttttcacgatcaaatatttgaccagcattcatagataataatttaataatttcaaactccttattagaaaaatcaatttttttatttttaataattacggttctttgactataatcaataatcagttccctagtaaaatgtcctcgtgatttatgggagctgcgtttttcacgacgtaaatgagcttgaactcttgcgaaaagttcatccatcgaaaatggttttgtaatataatcatcgcctcccagcattaaaccattgatcatatcccgactagaaattcgtgctgttaaaaatataatcgggcaattcacatgttcccgaatcatcgtacataattctaaaccattcatctccggcatattgatatctaataaaataaggtcaggtaaaactgataattgttttaaagcttcattagcatcattagctaaataaactaaatatccttcagattgaaattgtaatgccagcatttctaaaatgtctctttcatcatcaatcataagaatcttatacattgttttttccccctatagttatttttattatacttaagtttgtcaatttttggtcaacttcataaaaaaacttaagtattatgcatcaacctgcaatcgttagatttttaaggttcaatacaataacttaagctcttttataattatttagttgcaataacttctacttcaattaaagcccctttaggtaatttagctacttctacagcactacgagctgggaatggttcaacaaaatattgagcataaatgtcatttacagtaacaaaatcatccatattatctaaaaatacagttgttttaataacatttgcaaatgttaaaccttggctttctaataatccttgaacattctttaatgattgatgagcttgtgcttcaattccttcaggcatttcccctgtttctggtactaatggaatttgtcctgaaaagaaatacatatcaccaacattaattccctggctatatggtccgatagctccaggtgctttatctgtttttactacatttttcatctttaatatcctccttaaatcattataaacaaataatcactatttttaaagttttattaattaaaatattgctatttttatcactgtgataatttattattgacttattacaattctttgctataatgttgacaatacaaaaggaggatagcacgactatgaaatatacatttgcagctagatttaataacattactccaagtggtattcgcgctgtactagaaaaagcagcgggacccgatatgatcaacttctcaccgggctttcctgataacgatgcttttccagctaatgatattcaaaagatttcacaagatgttcttaaggaagatatttatactatcttgcaatattccagaggtaccacttatccaccattaaaaaaggcattaaaagctttctttaatcgtcaagaaaaaatttttacagaaaatgatgatctaatggttacttccggctcaggagaaggactggaaatggctgccaaagtatttttaaacccaggagaaagtatcattgtcgaagatcctacatttgtcggagcgctgaatggatttattagcaatgatgctaaactgcttggtgtgcctgttgaaagtgatggaatgaatttaggattattagaagaagcaatgcaaagcactcctgcccccaaactactatatattattcctactttccaaaatcctacctgtatcactacttcactagaaaaaagaagagctatatatgacttatgtttaaagtataatatcatcattcttgaagataatccatatggcacattgcgttttaaaggtaaaaccatcccgactttaaaatcaatcgatactgaaggaatcgttgtttactgtgcaagcctatcaaaaatcatttctccgggtatccggcttggaacaataattgcgaataaagaaattattgataaatttaatattcttaaaggggctagtgctggagccgtaactaattggtcacaacatgtaattgcacgctttttagaaacagttgatatggataagcatcttgctcatttacaatctgtatatggcaagaaaagtacatttatggttgaaatgatgaaaaaaacttttcatcctgatgtaaaattcactaccccagaaggtggtatgttcgtatggtttgaacttccaaaatatgctgatgctaggacttttttgaatagagctaccactatgcatatcgcaattgtaaatgaggaaacttttgccgttaacagacgtgataaaatgaatggttttagattatcttttactagtgcaacaatggagcaaatagaaacaggtattgctaagttaggtaaactaacatatgaattatgtaaataaatccactgattggtggatttttatttgttcgcgcgtataattgaaatgaggtgactaaaaatgaaacgtggattagttttagcaggcggaggttctaagggagcttatcaagccggctgtattaaagcattaaaagaattgggctatgattttgatctagtaaccggaacttcgattggagctctcaatggcctattagtcgttcaagaagattataacactctttatcgattatgggatgaaatcacaattagtgaagttttagaggatcctgtcaattttaatttttcaattgactcaatgctttcacaaaccaatttaatcaaacctttttttaaatcatatatcaatgaaaaaggtgctgatatcactcctttaaaaaacattctccatgctctttataatgaagaaaaagcctttaataataaaatagattatggtgttgtagctgtaaaatatcctaaattgactcctatcgaaataactaaagaagaaatgaagcctgtaccagccattgaatatgcaattgcttcagcttcatgttttcccgcttttccagtgcatcatattgataaacaaggttatatcgatggtggttattatgataatcttcctatttcgctagcgttaaaaatgggtgctgataaaattattgcaattgaattaaatcaagatgctactcatgattatttcctcgatcgtcctgatatcatatttattcgtcctagctatgatcttggcggatttcttgattttggtcgcgaaattcttgattggcggattaaacttggctatcacgatactttaaaaaaatttaaccagctaaaaggctatcgttataactttaaaaattttgaaatcaatcacgaattagcccataaattctatcgtttaattttaaactatgaagatagcataaataaaaatgttgttagtaaaacaattaccagcagttcaactcccttgagtgatctgctaaagaataatacttatttaaaggaactaacaaccgaagattactttgttcgagcggttgaaatcactatggatcattatcactatcaaagtgatcttctttatgatctaaatgaagtgtgtcacgaaatatttaacacttttaaagaagaatatcaggaacgctatgatattttagaaaaacggtttgtcgacatacctattaaagaactcttctccaaaataaaaaaattaagcagtaaagatgctatttgtgctttttatcactcattaaataataacgaagaaatcgaaacaactttaattagtaatatttttttagaagaatatttaatcgctttactactatatacgcttgtataattaactaaagtttgctagaatcctcctaggaggaattagtttgaatctcaaagtaaaaaacatgatatattgttcaatgtttgcatgtatcactgcaatcttggcacaaattcgatttaccttaccaagtctagtcccaatcactttacaaacactcgggatttatttaattggtctggtgttaaaacctaaaatagctttcattagttccttgatatatattttaatgggagccatcggcctgcctgtctatagcggctttagtgccggtttaagtactatattaggaccaactggtggctatatatttagttttccaattacagctttaataatcagttaccttgtccattatcgaagtaccactatttttaagtttggcgctttaatactcggaacaataatttgttatttaattggaactttatggtttatgtatataatgaagatgagttttagtgcttcattaattatttgcgtcctgccttttttacctggtgatgtacttaaaatctttattgcagcagccttaacaaataaatttaagaatataataaaagattagggaatttgctttcctaatctttttttcattttatgcttttgtttcttttcctaaacgtttatacgtttgataaaataatgtggctgtaacactaactgcaatcgtatcagcgattggctctgctaaaaatactgcaaatgcttgattttctataaacattggtaaaataaaaatcaatggtattaaaactaaaacctttcttagaacggctaaaaatactgatgttttagcatttccaatagcaatgaaagtttgttgacaagcaatctgaattccaaaaattcctgaagcggccatataaatacgaatcgcccaacgtgtatacgtcgccagttctccatgacttgtgaaaatataaataaaagtatctggtataaacatcgctactgcccataagagcattgaataagataatgagatttttaataaaagtttaaaagcgcgctttactcgatcaatattttcagcaccataattaaaactaataattggctgagctccttgagtaagcccttgtaacggtaacattgaaaactgcatcacgctagtcaaaatagtcattgaacctaccgcgatatctccaccatattttaataatgaagtattaaaacatactgagatgacactttctgtaaactgcataataaacggtgatagccctaatgctaaacatggtaagatgacttgaaaatctaattttaaattatctaattttattcttaagccgctacgcttacttgttaaaaaataaacaacaaagatagaagatatcgcttgagaaataatagttgctaaagcagcaccctttacccccattgacatactaaaaataaaaattggatcaagcacaatattgcataaagctccaattgcaactgtaatcatcccaatcttagcatacccttgagcattaataaacgcatttaaccccaaagccaattgaacaaaaattgtacctaaggcataaattctcatataatcaagcgcataaccaatagttgcttcactagctccaaagaccattaaaatcggttcaccccagattaaaaaaacagctgtcaagataattgccataattactaacatcacagtacagttaccaagaatcttttcagcttttgggtgttcaccacggcctaacatgattgatgctcggggagcacctcccatactaactaaagcggcaaatgctgaaatagccataataacaggcattgttactccaacccccgttaatgcactaggccctactttggggatatgtccaatatacatgcggtcaaccatattatataacacatttattatttgtgctaaaatagcgggtaaagctaattttaataataatggacctaagctatctttacctaaatcagcctcttttttctttttcactttaattactcccttcatctattttaaatatccaatgagtaattataacaaatttcaaagataattcaattctttaaaagattatctaatttacatcattttaaatactcattcatatatcaacacattgatatatatttttttcaattattaaaaaacttggcagaattatcatttcttttttattcatattctctttgataataataatatttgtataacttgttgaattaagctattttggcttaatcaacaaaaaatcatacttataatttataagaaatcattgatttatgaaatttgctaaacattataaatcttattcataattttgtttcaataaaaagatgataaaaaataagaaccatggggtaatggttcttatttctttacatctctaaatgagattacttctatttcattatcacgaagccactgttttaacttttcacttgttacgagtgaataatcatataatctttcttttaacatcgaagaagtagtcgccacatcataatcaataaaaccaggatgtgttactaaaatattcaaaccttctttaatttgataataaccatcaatgaacatattttcaaagtcatgatcatgttcttcataataatcatattgtttcattgtctgatcaataatcccctgctccaagtccattccgtaataacatactggaacattatattcatgataaattcttaccactgcattaatcaatggttctacttctaaaacgtgtaaatcaatgtactcaggcaattggccaactaattcaatatatttttcaatttgatacttagcttcgatgtaagcatcttcctcactaaataatggttcattattttttatttgtgctcgacgaatcgtactcgataaaaatatcccgtgttcatcaactagactaggaatcatctcttttggtgctaatgcatatccattagttacattaacatgtaatcctaaacacagatttggacactgctttgctaatttaattgcttcttttgcatacggcatattaaccatcaaagcaacactatttaccaatccctttcgatgtgctgaaatcatccccaatgtcactgcttcgctatatcctaaatcatcaccacgtatcaataactgctttaccataattatcctcttttctatattttatataattatactataccaaataaatagtctatacaatttattttttcatattcatgaaacatttatgatagtgcttatatttgcggtataataaaagataactaagggaggacaacacactatatgaaagatcgttttagtttatcatttaaagctttttatttaatctatttgggcgcgattggctcttttattccctacattaatacttatttagaaaaaaatgccggcttaagcggttcacaaattggcttaattacagccatcagtcttgttttaggggtatgcgtgattcctatttggggggtcgttggtgataagaccagaaaatatagtgcactattaaagttatcaattatggctgcactagtagtactttacttctattataaagccgctgtttatcctgctatcgtagtttgtgcaatcgcacttgaagtatcacgactaggaacaatgccgatggccgacacgctggcaactaattactgccataaaactggtggtaactatggttctattagaggaatgggctcattagggtatatgctggcaggaatggctgtaggatttttagctgatctttttggtcttgatggagcaatgtttgcaacatatgccgttttattaatcttggctttctcgatttccttcggctttcctaaagatgatggaaagaaagaagatggtgaagaagttaaagtaaaaaaagggagttttaaagaacttctaactaataaaaacttcttatttattctatttttacaactattaatgtcaacagttgtcgattctgctatgacatatggcggaaatcacttaactgttactttaaatagtggtgcctcagcaataagctggatgacttttgcaacagttttacccgaagttgcattcttgatgattgcaatcaaagttcttaataaaaccggctttaaaaaattctatttgattgcctgtgtatcaatgatgcttcgctttggggtatatgcttttattcccaatcaatatgcttttttagcaataagcatcgtacattgcatcggcgttgccatcgcaactgtagcaagtttaacctatattcgaaattccgttgatcccgcagttttaggaaccgctattacattacttaatgcgacactatcaattggtaaagccatttatggttacatttttggagtagtttatgaaatttggggaagttttataatgttcggaatttgtttgattccttttgtcattgctttcttaatgatttctcgttctcattgttttgatgaaatcgataaacataaaggtcatattgcataagtttatggatagatagttatatgctatctatccatttttagattaaattaaaatattttcttttaaataatataatttatattataatgatattcatggagaagtttatgaagaatatcacaaaaatgtttttatttatattatcgttctacttagtcttaggttccctttggattggaaaagatgttatcattcattatcaaaatattgatggtttaccaatcctaggttatcatggtgtcctcgaagataaagataaagaaaaatactttgctaattatccatactgtatgtcattgagtgaatttgaagctcagatgaagtatttaaatcaaaataattatcataccttaacaatggatgaaatcaacgattattatcaaaatcatacaccactacccaaaaaaagtgttgctcttacctttgatgatggcttattaaactttaaaacagttgttaaacctattttagaaaaatataattttaaagctacttgttttgttattggctataaaactacagtaaaaaatagccaaaacccttataagcatcaatacttaagaaaaagtgatttagtaaatgacgaatatgttgaatactattcacattcttataatcttcatcataacactaaatatcctaataccaaactaattgaaacattatccacacaagaaataatcaatgattttaaacaaaatgaaaatattgtttctagtaaatactttgcctttccatatggtcgaacatgtgacaatgctaatgaagcattgataaaagctaatgtttcattagcttttggttataaccaaaatagaacgatgacctatcatgatgataagtacttgttaccacgatatctaatgtttagtaaaatgccaatgttctattttaaatggatcgttgaataaaaaatgacaaggactgtttgttcttgtcatttttataattattataagacttttccattactagcaataaccttttgataccaataaaaactatcttttaaatatctctttccacttccatttccataatcatcgtagtcaacataaatgtaaccatatcgcttattcatctctgaagtacctgcacttatcatatcaattggtgaccagctcaaatatcctaagcatatgactccatccaactcaattgccttctttaactcattaatatgtttttgaagatacttaattcgatattcatcatgaatctgattgtctacagtcaaaatatcattagcaccaaaaccattttcactaatcaaaataggtaaattataacggtagtatatctcattcattgtaattcttaaaccaattggatcaatagcccaaccccaatctgatttttccaaatatggattttcaacaccaccttttaaattaccttcccctacttttctagcagggtcatgagatgctactaatgataaataataactaaaagatatgtaatcaactgtattatttttgattatgtctaattcttcttttgagaaatttaaatgaatatctcttttttctaaattttttaaataccagttaggataattcccattagcctgaacatctgcgtataaataatattcttgatttgctctcattgctttaagaatatcatgcggatcacagcttgctggataagttgtaaatgaagcgatcatacaacccattttagcagttttatcaattctttttagctctctagttactaatgcacttgctaaaaactggttatacagtccctgatgcactcgtgtttcatataattgatcttgactaaagggaactgctgaacctttaaatggtatttctaatgccgcattgatctcgttaaatgacatccaatattttattcgtcctttaaaatgtgtaaaaactgtataacaatatgtttgaaaaaatttaatgacttctttattacaccagccaccatattcagtcgcaataactagtggtgtttcaaagtgagataaagttataattggttcaattttatatttaagtaattcattaataatattgtcataaaatttcagtcctgctttattgggttctttctcgtcccctcgtgggaaaattctcgaccagctaaatgacattctaaaagctttaattcccattttagccagtaaagcaatatcctcttgataatgatgataaaaatcattcccccttcttttgggaaaattattacttttattttctttaagttttttaatttcttcaatggttaattcctttttagctaaatgacgttccttcttttcataaaacataaaaacatcggctattgacattccacgcccatcaaggtcatatccaccttccatttgattggcagcacttgcaccaccccacagaaaatctttatctaattcacacataccgaacacctttcctttctctattattgatttatgatctcttactccaatcgcaaaatatcatcattatttactactgtattcatatttaacagctcgactttattataatgattagtatttgttacaataacaataatagttggatcatatcccgcatggttgatttcatcaatgttaaaatctagtaataattgtcctttcttgaccatatcaccttcttttacaaaagcataaaaaccttttccctccattttaactgtatcaattcctacatgtaataatatttctgctcctaatattgaccttaacccaattgcatgattagtcggaaatacagcaacgatcttagcatcacagggagcatataatttcccttcatcaggaataatagcaaccccatttcctaatgctaacgaactaaaagtactgtcatttactatttctaacggcaatactttaccagtccctacagcacctaatatctcggtatcaacctcaagcagttgatcagtttccttgattacatcatcatttttttcaacaaattcatctttccaaaataataatactaatactaaagttccaataaatgaaattaataaaccggcaatataccatacaaacccatgttcagcaaacaatggtaatgataaaattccacctgctggcaaccccgtcgtatagcatccagccccaccaacaactgcacccccgaaaccactcattagacatgccatgaaaaaagcttttttagccttcaaagtagttccataaatcagtggttctgtaattcctaaaactgagggaattacatttgctgctgcaaccgatttaaaatttttattttttgatttaaaagcaatccctaatgcagcaccagtttgtgcaaatgctgatggcatcgtcattgctaacaatgcatctctaccagttgttgcaagattatttaaattgacaggaataaatccacgatgtaaaccaaaaataactaatggctgccaacatgcacaaaatataaatccaaaaataattggattgaaactataaactgctaataatccatctgtaaaaacatttgttaaaaatgtcactactggtccaattgctaataatgataatggagccataataattaaatcaatcaatggagtaacaaaacttctaattattgaaggcagtctatcacgaatcagcctatccaataatgatgcagcatatactgcaacaataatcggtactacagaagatgcatatttaattaaaatcacatcaagtcctaagaaagataactttgcaccttcactaaaagctgtcaataaggttggatataacattgttccagctaaagtgactcctataaattcatctattttaaagtaccgtgatgcactaatcgctaaatagaacggcataaaatacaagattgcatctgcggcagcatataaaatcatatatgttccactttcagttgttaatattcccatactagtaaatatggttaacaatcctctcaatacacctgctcctgccataacaggaacaaatggtgtaaatatgcctgaaaataatgcaaatatcttatccaataatttcttatttttatttgactgttcctttacagtacttattttagctgttgccaagattgctttatatacatcagcaacatgggtaccaataaccacttgacactgtccacccgaaaataacacttgaagaatttctgaactattttctaagtttactttatttactttctcctcatcttttaattcaaatcttaacctagtagcacaatgctgtactatatttatatttttttcgccaccaacattttttataataaatcttgctaatttttcatatttcatttttttctcctcctaataaaataacctagaataaaacatgtattcaatcatgtttttattctaggtttagcttgccaaagcaataacaatcctaatattttaatcttgcaatatgcaaagttaaatacaatttttccgcctgacttaaatcttttttataaattttttgaacatgtttttctatattttttacacattcaaatgcttctggatatctttcaataacgatgtcaaataatatatcatctcttttagcttctttttcaccaaacatcagccgctttgcaaaaaactttaaatgtgtcacaaaacgatgatagtctagagaatcctcatcaaatgatatctcacaatattaagtatttcttgaataattttggtaatttgagttacttcttccatttcactattaagttcagcattgacaaaatgtagagcaataaaaccaacttcatcttctgataaattaaccattaatttttggttaattattttcaaagcttctgctgcgatcttatattcctcttgataaaattgcctaatctcccataaaagcggattttgaacattaattccttgtaaatatctctctatagcatagtttatatgatcagtaagagttatatatattccatcatttaactctttatccaatcctttccgtgcaaaatcaataatttcatcagtaacattaagaacattgactggaatatccttaatcaattcaaggaagcgattgttttgtttatcattttttaaataaaattgtttttcaatcatttcatctagaacaacttctccccgtgatttttgatatgcaatacctcttcccataagaataatttcattatgattttcgtcaagtgagcttacaatattattattaataattttatgaattatcataagacacctccttttttgcatagaaaaagccaaactcaaataatatatataagaaatatatatccatcaaagtttagcctaattgaatagtaacaatctttgtaattttatgatagcacttccaaaattaattgtcaattaccaatcatatatatcaaaaattagttgttaattccttgatgcggcacaaacgaactatctgtaattgcctcaaagcgataaccacgtgctttataattttcaattattgccggtaaagcctgaacagttgttgatttggcagctgtatcatgaaatagaatattaatattattagctttacttgcagtagcattagcaattaacttgctgactgctacattatttcctgaagcatctgtagaatcgccattccaatcataatattgataaccgcgattgattaattcccttgacaatacagtcataatacctggacaatatttacgtgataccgtatttgaagaacctccaggaaagcgtacatatttgggtacaaacccaattatatccttcaccatattaccgacttttgttaaatcgtcaaaataagcttctggtgaagcataaacagttttatagtcatgactatatgtatgcaacgctattgtatgtcctttatcatgagcagttttaattaaatgattataaggtttattattcccagtaacaaagaatgtcgcctttgctccataaacatctaaaatatctaaaatcttttgggtattagctgatggaccatcatcaaaagttaaataaacgattttatcacttgtttgattattgcttccaattgctttcttttcaactactttaatttcacgctgcttttctattttgtttccagaacgatctatccctatataaataagtgtataagtcccctctttttgaatattcacattactagaatcaaccgttaattttggttcgggatcacggttatcactaatgctgacaccactattataatctgtttttgcccctatcacgatcgtcaaaggctctaaccctgtaatttggggtggctcactatctttagtaaccttgacttttcccttcttttcagttacattatttcctttatccttaacctgaataattacttcaacagttccctctttactaaaatcataatcttctttaaaagaaacttcagtttttgttgcatcattaatatttgttgccatacttgcaggatcaactttcattcctaaatcaatatcaagatcaacaacatcaaactgtggttttttagtatcaactatctcgatcgttgcttcatattttttatctttatatatatagattactggatatcttcccaacttattataatctattttagaaatatcagcctttacatctttaatatttccattgcgtacgcttgcgatatttttcatcacatcataactatcattaatctcgactttgataatatccgctttaaagactatcggtgagcgggttaaaaaatatgttgctactccaccaactattatgactagtaatactgatacaattacaatcttatttcctatagttaaatttttaatttttttcattatatctttcccttaactaatttatatacttttagtatatgtcaaacctcagtattttacaatctttgtcaataaaactatttataaaaatcaactaaataaaaaatacttatctataatcagataagtatttaatcattattaatcaattatagcacggacattaataattccatttgccgactcaatccgctcaataatatcaggtcgaacttcatcatttgtatcaattagtgtatatgcatattcaccacgagagcgattaaccatattttcaatattcaaattatgatcagcaaataatttagaaatatttgctaaaatattaggaacatttttattaataatacataatcttgttttagacattcttgcttgattgactcctgggaagtttactgaattaatgatatttccgttttctaaatattcacaaacttcttcaaccgccatctttgcacaattatcttctgattctggtgtacttgcacccaaatgtggaagaataataatattttcttgtccaattaattctggtgcagcgaaatcactaatatatttattaattttaccgcttgcaacattagctaataaatcttcattattaactaaatcaccacgagcaaaatttaaaattctgacaccggttttcatctgtgcaaatgcttctttgttcatgaaaccttttgtttctttagtactaggtacatggattgtaatatagtcacattcttgataaatttcttctaaagaagctgcatgacgagcatgcttagataaagcccaggccgcatttacgccaatatacggatcataaccttttactttcattcctaatttaatagctgcattggcaacatttactccaatagcacctaagccaattacccctaaagtttttccttcaatttctggtccaacaaaattacttttacctttttctgctgttttagcaatatcctgatcgtcttttagaccatcaatccaacgaatactttcaacaatttttcttgaagagagaaataatccacataatacaagttctttaacagcgttagcatttgctcccggtgtattaaatacaacaattcctttttcactacaatcatcaagtggaatattatttactcctgctcctgctcttgcaatagcttttagattttccccaaaatcatattcatgtaaagaagctgatctaaccaaaatagcatcttcattagtcatttcttcgctataagcataattttcgtcaaatccatctaatcctactttagatattttatttaataattttatgttatacataattattctcctatttgttcgctgcttcaaaatctctcatgaaagcaactaatttttcaacaccttctaatgacatagcattatagatagatgctctaattcccccaactgaacggtgaccttttaaattagtcatacccgcggcaatactttccttaacaaacttagcatcaagatctttgtttggtgtagtaaaagtaacattcattaaagaacgattatctttatcactatgtgcgatatagaaatcactactatcaagataatcataaagaagattagcttttttaatatttctttcttgcataacttcaagtccacccatactatcgatccattccaaaactagtcctaatacataaatcgcataagccggcggagtattatacattgaatcattttcaatcatcaatttataatctaataatactggtgttgtcgcagcaactttttgtaataaatcttctttaataattgctactcctaatccagcgatccccatatttttttgtgcacctgcataaatcattccaaactttgaaacatccactggttttgataaaatatttgatgacatatccgcaattacaggaacaccattagtttctggaatatatttccattcagttccgtaaattgtattatttgcacataaatgaacataagatgcttcaggatctaatttcaattcgtcttgagttggaatatgtttaaaattgttttcacttccgtcataagcaatattaatttccccaaatttttttgcttcggctgcagcttttttactaaaagctccagttacaacataatcagctttaccattttttaataagtttaatggaaccattgaaaattgttgtgttgctcccccttggataaacacaattttgtaatcatcagggatattcattactttctttaataacccttttgttttttcaaaaatgtctaagtaggaagaggatctatgactcatctccataacactcatcccactattttcatagttcaacatttgtttagcagctttttctaaaactggctcaggcaacattgaaggacctgcagaaaaattcagtactctcttttcagtcatatatatacctttcctttcttgtatgtgaagtctattatattgtatacaatctaatttgtaaagggattttgtaaaaaattgtatacaattatacatcgtttcataaaaaagctatttttcttagtaattatcagtttcattatatgctggaacatttgataaattcacgatattttaactacatttacgataaaataaattgaattaaatacatttctaagatatgatgaaaaggtacatataggagagaaaaaatgaaaagaaaaaaactaaaattgaaaaaacaagcttactttgttattggtggcctcgtcatcctagctgcccttatactataccttattttatgtttagtaacagggggagacaattttgtttcaaatacaactatcaatggtattaaagttggtaatatgaataaagaagaagcacgtaaggctatagaacaacaatatcaaaatgatttaaatccccctactttaactttattactcgatcaacaagaatacccagttgatttaactgataatcttacattcgatagtaaaaaagctgtagataaaatttctaaacagtctaatagttcattcttcagacgaggatataactatttgtttaatcatgattatacagttggggtaaaaataaaaaataaagatcttttaaatgaaaaaattactaatagtcaaattctaaattatagtactttgactcctactaactatgaacttaaagatgataaaattattttcactaaaggaaaatccggtaaaacagcagaattagaatcagttttcaatacaattaataaggcattaaataattatgattttaaagggaaaattaaatattctccagtagaacataaacttaatgatgaagaaataaaactaattcatgaaaatttatcaaaggaagctaaaaatgctactctagataaaaataacaattatgaaatcatcgatagccaagtaggtgctaaatttgatttagaagatgctgttgctaaatacaataaaactactgaaggtaaacagtttaccctaaatgctacgatcattaaacctgaaataaccaaagaaatgttagaacaaaatttatttaaagatgttttaggtgaatatgcgactaacgtcagcggtacttcagttcgtaaaaataatgttaaactttctggtgataaatgcaatggagttattttattgccaggtgaggaattctcttataataatgttgttggcaaaagaacgaaagaaaatggtttcggtgaagctgcagcctatttaaatggagagactgtgcaagaagttggaggtggaatctgtcagacatcatcaactttgtataatgctgtattgtacgctaatctaaagattactgagcggactaatcatacttttgtttctggctatgttccaatcggtcgtgatgctacagtatcttggggtggccctgattttaaatttaaaaatgaccaggcttatcctattaagatcatcgcttcttatgaaaatagtcgtctaacaactaaaattttaggtactaatgttaataatattcgtgttgagctaaaaagtcaaaaacttgcttcaactaattataatactaaatatgaagacgatcctacattacccgaaggacagacaaaagtaaaacaaaaaggaactccaggtagtaaagcaaaatcatggcgttatgtttatgatgctaatggcaatttaatttcatcaaatgaagaagcatatagtgtatataaaggacatgaggaaattattttaagaggtactatgaaaataactgaaccagctacgcctgcaccaactgaacctacaactccagcacaaccagaaacgcctaccattcccaataatgaaacatcgtagaatcttaaattaaatactggtggaatttttccacctttttctataattaaaaagattattacataaaataataatctttttaattattttatttttgtgcaatcttccacttttttaaacaatactgatatatctcttgttctgaaatcattaacgaagcactagctagatttatttccatattcttaccattcttttcaagaattatcagaaaataaaaaggctcatggtgcagctgaatttccgcaaccttctgccataaaatcacttttttccatagcctataagaagtgataccatctttatcaattacaaactttttcattccaaaaaatatcaattctaataattcaatagttccaactattacaattaccaaagaaaagaactctagcaccccaaatataaataaacaaaatatcattatagctgatgatacattcgaaataaatcctgaagctactattggaatgcttatcataattaatgaaaatggaattatggataaaataagaatagttgttaaaatcatatcttttctaataataattctttccacttcttttatcctttccaccattcaagtcattacattaaaacatactttattttctgtaaacttgaaaataattaaatattgtttacgaatacaaatatcagggtttgtattcaagtgttttgtaatataaagtatttctttttaggaagcaaagtagactttttctcacatagaatatataattaaataaacaaacttaaataagatattttcttaattttcacaaatattatgattgaaaaaaacaggaaaaaaggtctacattttttcctgtttttacttaaataactttatttatattgattcataatcctttacccatctagtaaaggtatgattatttgtacttaaacgacgcgaagcttcagctttgctgattacattttttcgccataaataataaatttcttcaaaatcgtcgggaatcgttaattttggtcttccaaatcgtacgcctctacgtttagcttcacgaattccctcggcttgtctttgacgtgtattttcgcgttctatttgagcaacataagaaagcacttgcaatactaagtctgcaataaatttacccgtaattccatcatgcttttcacgtgtatctaataaaggaaaatcaattaccacaatatctactccgattttcttgacaatataacgccactgttcaatgatttcatcataatcacgtccaagacgatcaattgatttaatgtataaaatatctccctgttttaaaacctgaagaagtttttgataatgaggacgattaaaatctttaccggactgataatcaatataaagctggctccctgtaagtccaacctcttttaaagctgtaatctgcctatcaacattttggtctttacttgatacccgtatatatccatatttgttatattccattctatattttcctcctcgagtaaaaattatggcatagggaaagttagaatgctataaatggctaattatttagggattctttgcatcttacatcgtcagcagtgataaatccatttttataatcgtaatacgataaaattaaaacagaaacaataatcaacaaactatcgcttctgtttaactaataaaatttaatttataattataacatcgtcttttcataaatatcagcaatgttagttccaacatgatctggttgatgagcatcacttgctgtaatcatcgatactccatgttcttttaatatctttaacaattcttcgcttaatcccatatctttatgattataacgataataacatcctgtattattttcagcttttacattatgttcaaccaacaaatcagctaactgatgataagttggtgttaaatcataggttggataataattaaacatttttattgtatctggatgtgctaattgcgtaaataaatcagacttaaccaatgaaaaaatcaattcataataatcacgataaatatcatcaacatcaaatttattccataaaatatctttagagaaattcatgtcatataatctgccattaattgagtgtattgccccaacaacaaaatcataattatggttagctaatacttctccaatcttcttttcatgtttaggcacgtagcatacttctaaaccaaatgtaacttcaatcggcaaatctaatgctttaacttcctcaattaatttatcataatcatctaaagtatccttaaatttcattgctttattctctagccattttttttgcaatggctcttcttttaattctgtataaatctcttcaaactctttaaaacgatgtgtgtgatctaaaatttgaatctttgtcaaaccttttttaacagctgcatcaacaaactttaatacatattctttatttagatccccatattctaaatgcatatgtccgtcaatcatctttatcaccccttctttttttatgattatatgcaattcttaaaaaaaagtacagtaataaaataaaaaaaggagccaggggagactccttataggatggatgagtttttgggagagggaatcatccatcatttaagttgtaaaatatatatgaggggattaatatattttacatattattatggtttgtctttcgacactattatcctagcaccgctctatgaattaaatgtgaaccgtataattttttaaaataaaaaaggagccaggggagactccttataggatggatgagtttttgggagagggaatcatccatcattcaggttgtaaaacatatatgaggggattaatatattttacatattattatggtttgtctttcgacactattatcctagcatcactctatgaattaaatgtgaactaatctaaaacaaataattagaaattttatccttcgattatttgatccaaccatgcaccctacaagcattataaattccatcactagtattgcgatcagttatataatccgctttagcttttaattcatcacaggcattacccatcgcaattcgatagaaacgttcatcaaacataacaagatcattataatcatctccaaatactacaacatcatcaatatttccttttatcatcgcaatcatatcaactattccctgctttttatcatctggctgaaacattaaatattcttgttcaaaacgtaatgaacctaacgtatcttttaatgttaatcgtgtttcttcactagctggaatagaaatataaattttataaatattttctaaattatgataatttatttcactatcaattgtataacgtgttggttcttttcgataacctgcttgttttaaaaataacgtatttttactgtatacatcaatactatcaaatggagctattaggattccatagcctaaattttctgcttcatcaataacagccaatgctttttgccgatccaatggtgcattttttactaactgatgatttatgacaagaccattaccaccattacaaaccatattatttaaaccaacttctttaagaaagtttttagctttataataagcgcgtcccgttgcaatagctacaaaattaccattttcttgtaatttatctagggcttcttgggcacttggaacaatttttccagttgtattatccgtcaaagttccatcgatatcaaaaaatatatatttcatatcattcttctccaatttctttaaagaatccataaataacagctccacaaagacttcctgctaataaagcaacaatatatctaaagggatgcgctattaatggtaatacaaagattccaccatgaggaattctaattccacaattataaagcattgaaaaaccaccagctactgctgaagcaacaatgcaagctaatgttactaagcgggggtctttttgaacaaaaggaattgtcccttcagaaataaacattaagccttttaagtaattttgacaacctagtttacgttcagttaatgtaaatttatttctaaagaaagttgtactaattgcaattgctaatggcggtaccattccgccggccattacagcagccataacatcaaagttaccttcaacaatttgagctattccaaaaagataagcaattttattaactgggccacccatgtcaacagacatcattcccccaacaataactcctaaaattagtttataaacaatatccatactaccaataaatacactaatagtctgatttagacttccaacataaggactaatcaaatatgataaaacacccgtaatcatgaccccaaaaatcggatatattactgttggctttataccatctaaacattctggcaatttacgacaaattttttgtaataaaattacaacatatccaccaataaagcccgctatgattgcacctaaaataccaggactaggcatattttgtagatacatattatttaataacattgcagccccgccagcaagagctactgcaaatccctgctgacttgcaattgcctgaccaataaagccagcaaataaagcaacgatcatcccattaacggttatccccagaatataactgttacttagccaaatactatcataaatttgtttgattccaaataaattataacttgctgctaatgaagcaattgaaatcaatgcacccgatccaataatgattggcaatattttacttaaagcatctgtcaattgggtatataattttcgccaaattccctcattggcagaactactaaccactttatctccttgatgatgataaatttctacattaccatttattgcttgcgacaataactcctctgctttattaattccatcagctactttagttataattacaggccgaccatcaaaacgtgacatctccacttgtttatctgctgccacaataatacatcgtgccttactgatttcttcagccgtaagaacatttttaggccctgttgccccatttgtctctactttaaataatatgttcatttctttagcttttgcttctaaactttctgctgccataaaagtatgagcaattccagtaggacatgcggtaactgctaaaacttcataattagtaccgtcagtttcttcttttactttcactatttcattttctttatcatcaattaatcttaaaaattccactgcatcactagcattaattaagttttctttaaaatcattatccattaacatcccggataatcttgctaatgtttccaaatgaatgttaccaccatcaactggtgctgcaatcataaaaaacaaccgtgctggttgactatctaatgattgataatccacaccatctttaactatcattactgctagtccaggtttttttactgctgctacttgggcatgcgggattgcaattccttctccaattcccgttgtactttgagcttcgcgagctaaaataccttttttaaaggctagtttatcactaatatttccagtacccaccattaaatcaactaagtgatcgatcgcttcttctttattagcaacttccccattcatatcaattccctgcagacataataaatctgtaattttcattattcatcctcacttattgtttttaataattcatctattttttcttttgatgccaaatcttcactgaatgcagttgcactaccagtagctgtagcctgttttaaagccgttttgaaatcatttgtcttaatataaccgtaaataaatccagcgaccatactatcacccgctccaactgaatttttaacctcacctttaggagcagatgttatatgtacatcattattttgatcgactaatactgctccatctccagccatcgaaactaacacatttttagctcccattgtttgtaatttcttagcataaacaacgacatcttctttatttttaatttcaacattaaaaatttcagctaattcatgattatttggcttaatcaaaaatggatgatgctttagacagttcatcaataaattattagttgcatcgactacgatcaaaacattttttgattttacatattccataattttttcatatatatcatccggcatactgcctggaatacttccagataaaactagaatatcaccatcttttaaattatctaacttacctaataatgcttgaacttgtgcatctttaatttgtggtcccatcccattaatttcagtttcattatcagatttcatcttcacgttgattcttgataatccggcaacttcaacaaaatcagtttttaatcctttagcttctaatccctctttgattgctttgccagtaaatcctgcgataaatcctaacgccgtacttttttcacctaaagtttttaaaacgttagaaacattaattcctttaccaccaaaaaacatgttttcttgttttgttctattgacaattccggtttcaaaattatctactttaattacataatcaattgctgggtttaacgttactgtatatatcatcttaattttctccttaagttaatttttaatccactcttagtatatacttaggtgtattctccgtcaaattaatgagtcaatatttattttcaaataaagaaatttaatcttataattttaattatttaaacttaataataattttaactccattaacaagcttcttacaaaaacaattgaaatcaccttatatttatgatatcttttatatagttagtcatagctaaccatataaaaggagtgattatatgccatcaactgcattattatttgaatctaaacttgttactttttgtagtcctactttattaaaaatgaaagctggaaatatttttaatattagcaatgagttcaatgaattagaagagtgtttaaattattacaaccaactatgcaatcaaagaggaatatacatttcgattattcatgaaaataataattcaaaaatgatttatgtttatcaaaaagaaaaattaaataacctttttaataaccataaatttagagctgttctaaataattatcattacccttatcaagatatcgacagtctaataaattggctaaagattagaatgaatagtagtgaatttcctcatgaaatcggtttgtttttggggtaccctttgactgatgttaaagggtttatcaacggtgctgattataaatatattggatattggaaagtatatagccatgttccccaaaccctctgtacttttgaccgatataaaaaatgcacacaagaattaaaaagacgtttttgtcaaggagaacgaattgaacaattattagcccatgtttaaaatcataaccatttcaatagcacgtgcctttttgtctcataataaaaaagcctgatcataatgatcaccggctttctattatccaattgaagcaactattgtagtaactaaattatcaatatcatccacttgctcagttttcaaagttgacttaattgtgattggttcgttgatgatttccatatccttcatcgtctctaatttagtacgcatgtgttttgcgcataatgctccccatgttccattttctaataacgctacacttcttttctttaatgataaagcaatcatatcactaaggaagttttccattggtggaaaaattccactattatatgttggcgctgctaaaatcaaatgactataatggaacacttcactaattaaattagaaacatgcactttagatacgtcatacattctaacattttttaccccggcttgcttcaattttgaagcaattatttccattacattttcagtattaccatagatcgaaccataagctaaaacaacacctttttcttctggttcatatttagaccaacaatcatatttgctaactatgtaatcaatattattacgccatacaggtccatgaagcggacaaattgtggcaatttctaaactactagctttttttaataacatttgaacttgtggtccatattttccaacgatattagcataatatctcctagcatcatcaagccattcatgttcaaaatcaacttcatcattaaataaagctccgtctaatgctccaaatgttccaaaagcatcagcactatataatgttttatcataactatcgtatgtcaccattacttctggccaatgtacgagtggtgccatcacaaaagtaaaagtgtgttttcctgtagttaaagtatcattctctttaactactaacttattgatctcaatcccaaaaaattgatcaatcattgtaaatgttttagcatttcctacaatcacgacttcaggataacgatttatcacttcttttaaacatgcacaatgatcaggctccatatgattaataacaatataatccaatgatcttccttgcaatgctgtttcaagattatcaaaaaataagtgtccaatcgaccaatcaaccgtatctaataaaatggtcttttcatctaacacaacataagcattatatgaaattccccttggaattggaaaaatattttcaaataaacttaagcgacgatcattcccgccaatccaataaacattctcatttacttctctaatacaattcatcatcacagcctcctaaatcacttttagtataaacctaatattctaattttactaatatgatgcttatattatttccaaaccctaaactattatccctcaaagattagtttagcagctccatattagctaatatctcatttattttttcttcaatttcttcttcacttttaccatctaactgctccaacaattcttgaataaaaggatcattaaatgcctcatcagcagtttcaaggccaaaagcatccattatcgccccttcaatttctagcgttatctcatcttcaaaataatcaatatcatattgactaataaaattcaagactaagaaaagaacatttaaattatttactacgattcgttgtggtttaccataacgattagcatattcaagcaatccatcaattaaagcttcaccaataatttgtaaactaggaaaatcaacttctttaattaaataatcgctttctccggcaattacggcataaacatttaactcattggttttatctgtattagtcattggtaaacagacaacatcaacacataaacgttctgtattttcacgcttagtttcaagctcatgttcacctaaatagccaaaatcatagcgatttaagtcaatttgtggttcatgaacaaaaatagcactctccttaaatttaccatcttcaacatatatttcaataatttcatcagactcactacgattttgatcttctttaatcccatttgcaaattcttttaataattctaaaattacccttgcttcctcaacttctaataagcatggaatatatcccgcttcattacgaaaagcagccaaatagttatcctcatctaatgccacatcaaaatcaagttcctgttcagataataaaatagtccagcagttgcaaaatgcattatttattccttcattagcaagattataaaaaccctctaaaagatcattataagtttcaaataattcaatcacataaccttctaatgtttttaaaataacccaatatgtagtttggttagatactagtttaatcacttgattatcagtaaactcacgtttcttcactaattcttttaactgctctaaaatttcaataaactcattttttaacgggctattatttaatatttcatcaacccctaacaatgataaacaactattaatatcttctagatcaaaattaatatccagatcatctcgacttaatataatttcttgataacgttcaattcccccacaatcctctatcaaattattaccacaaaattcaactacaacaggatagtgctcaacgccctctaactcttgttcaaccgtaattaaaagttgccaatcatcaccaaagtcataatggtagtaaattaccatttctttttttaaataatccgcaatccgttcaagattatcaactatctcaacgtcatcatttatctgattttcaatatctgtttcaccaccaggaatccagatccctaattccttgatcctaaattcatatagatgataatcttcaaaaccaaataaagtttggattaactgatgcagatcttcaaaactaattattgcaggtattttaatacgccgccatataggatccgcacacccctccacatctatcctcaattgatatccattcatcttttatctcctcagttctatataaactattataacaaattatattattgaagtaacgcctttatattgagaagataaaagggatttataaataattatcacgctcgactattttcaacaatcaatgttaaatgttttgtgaaataacgattataaatcacaataatttggccaataaatccagcagataatattgttcctatcccaattccaataattttccccgccaaacagtatgtagtaataattgtgacaagcatcattccacaatcaaataataattttgtcttaccaaactctttgtcaatcacctggcttaatgctttgaccataccatcagcaggattaggaattaaatctaacattacaacaacatatgctcctaaagcagtagctaaaatagcaatcgctaatagaactaatgcaacaggtaatgaagtaactgtaaaatttaataagttattataaaaatctaaaacatatcccataaaataagaaaatggaatttgtaataaaactttaaaatctaatttctgataaatcaataattgcactccaacaaaaataatatataaaatagttgttgccatccctaatgataaattagtcatttcactaattccaaatggaactgaattaattgctgcaacccctaaaccagtttttgtatttaagacaattccaaatcctaaaatcaatatccctaaaaaatataatcctaacctttttgccataaacaccctccttatttttctttattttacaatattacttgatattatcagttctttttcaacaaaagaaaaaatatccttccaaaagaagaatacttcatcaatcaatttttaaattgacaattccagtttttgaatatcgaaaaactaaatatagccattttgcttcaatcaactcttgttttctgttcaatagatcactaataatagtattatacttttctaaaactgccgcagcctctttccagatttttccctcgattaaatcgtagttatcaattacttgagcaacgatcattgagtctatttctcctgcttgtgccatttgatttaaaatttcacaagtcttttctttactaaaagaagttttataactgcgctttccacatagtgcacttacaatatcacttattgctacaatccgctgctcttgagtcaactggttttcccataaactatgcggataacctgaaccattcagtttttcatgatgccgacacgcaatttctaaaatttcttgatctattttttcttctaataattctcttgttttaagaacatgactacgcattattatcatttgctcttgagtcagttgacccggatattctaatatttcaattggaattccaattttaccaagatcgtgcatcattgcaccataatagatcttttttgtctgttcagaacttaagcttaataatcttgctaactctaaagatatcgtgcatgtggtaatagtatgtgtaactgtaaaataactacgaaaatcaattagagaaactaacatatttaaataactatccaactattctaatgaaagcgaaatatttaaactagttactttttgccattttgaaaatggattagttgtaaattgatagacttgatcaacctgccaataaagagtagtaaccaaattttctacaaatctagttcctgactccttatctaagtaatctttaagcatgctataatcatttgaagtttgtaaaaatacatcaattcgatcacacaaattaataatctgagagatatttttaatttcgtcatcaatataaatcattttttgataatcaagatgatgataaagaatagcaggtgccaatttatctagtggtgaaaagttctttatgaacaaataaccataaatagcatgttgccatatattttttgtctcaaaaataaacatttgatcaattttttctgtcttatatgctccaatatcatgtagcattgctaacataaaaacatcttgcaagtacttttgttcatgactattttgagcctcaagcatacgatatgtcatattagctactcgtaaaccatgatcaatcaatcgcgaatcaacataattcaaacaattacttataatttcaataaaaccttcattatttactcctgcaatattattcaacttatttttccatcgcatccactgacactttttcctctcgataaaatatcaatacaaaaacaattgccagtaaacctgcgattatcttactaatcatatagattatgacgccattaccatcgactacactagaaatgaatcctagctgtccccctaaaacataagctccacttacactaaaagcggcattcatcatcttccctttacgatccatttgtgaaaacaatggaatcattgcaatgcttgtcccaaggcttaatagtagtcctatcacactagcactattgacacccaacttttgaccaatcatgaaaatcattcgtgaaaaacgtttaataatcaaatcgcttaaaatcattgatccgcacacaacaatgcacatccgtaaaacaattaccattgcatcactaattaaagcagttgtagtaaaaggcaatgtatcaaaaaacagctgtaaaacaaccattccaaacaacaagatactaataattctaatcaaataaccaaataatgttaaaacaaaaatggttttatcataagaaacatatagagcaattaccaagataacacaaagtataattattggtaataagttaattaataaattaggaatttgtaaataccaggcaactgccactagaattattggtaaacttaaaatcccataaactaatccactaataaatggatttaaatcttccttttttaaagatgctaaaaaaattggtaattgaaaactaattgtttgtcctaatgttgcagtcaaaataacccctgaaaaaatcaaaaaagtactattaccaagtcccgaaacaattgaaaacccacccatatcaggtgcaagaatactcccaataacaattgatggatctaatgatgaatcggcacttattttagtaatcacatctacattattttgaatcaatgtaattgcgatacaataaaacccaatcatactcatggcaattccacccatcgaatccatccctttatcaaaagcagctactagtcccaacttattattcaagatcttgtcaatcaagccaatcaagcacaaaataagcattattaatataaaaaaattcattatcgtacctcaatttccatattcttccaatattttaccaaacaaacctcaaacaaaaaagcctattcggcttttatttaaaatattcagtaatattatccttatcatcaaaataattgatcttcattgcatctttagcacgtttaagtgttgcattcgctttttcattagctttaacacaaccatcttctaacactttcataacagcagcaatatcagcttgtaaaacagctcttctttctctaattggatttaatgtttcttctaaaacattaaataaaaatttttttattttaacatcacctaaaccaccacgacgataatgctcttttaattcatcaagatttttataatcaggtaaatatttttcaaaatattcatctttgcaaaaacaatccaaataagtaaacactgtatttccctcaacggttcccggatcttcaacttttaaatgatttggatctgtatacatactcattacctttttccgaacatcttcactagtatccgcaagataaatacaatttccaattgactttgacatttttgctttgccatctgttcccggcaatctttgacaaacttcattttcagccaacataatttttggatctaccaaaacatcaccataaatccgattaaaactgtgaacaatttctttagtctgctcaattaacggcatttgatcttcaccaacaggaacacaagtggcatcaaaagctgtgatatcggcagcttgagaaaccggataatttaaaaaaccaactggaatacttgtttcgaatccacgctgttttatttcctccttgatcgttggattacgttgtaatcttgaaactgtaactaaattcatataataagccgtaaactcaaataatgctggtacttgagattgaataaacattgtggttttttcaggatctaaaccaactgataaataatctaaagcaacctctaaaatatttcgtcggactttttcagggttatcagcattatctgttaaagcctgagaatcagcaatcataataaaaatttcatcaaattctcctgagttttgtaattccactcgtcgtcttagggaaccaacataatgtcctaaatgtaatcttcctgttggacgatcgcctgttaaaataatatttttcatataaatctccttctttgattaaataaaaaaggcttttatcctcaaggataaaaaccattatgccaccttgtaagacaccatcatgtctgtttttcttaacgcgaaaagcacggcgccactactccagttaagtttcattttgcttctaaccaggcccattcatcagtatctttatcttggctctcaccagccaccaagtctcttaaataaagattagctgtttactcttcctagattatcgaatttactatacttaaaatcataaaacggatataaaatgatgtcaatagtttattaataatcttcaattatttttatttttttctacaatctatcttgattccaatgcctcttctgtatattcaacaaaatactcttgataataaataattctaattaaatctaagattgccataatttgataattaaaactaattccatcaaacttacccggtaaactaaagaaatacttaatacaacttaagttctcattctcaagtagttgattttgggtaatcaataatgtcttactcttgcttaagtgccctaaagattttttcgctaagaaatctcttaatgaacgcccagtagatgaaaagaatactacaaaatcattttcatcaaatttaatatttggatcataagcatgatattgaaccacatttttacctaatgtaattaaatcagtttgaaattcaacagcaatactagttggaaacagtcctccaacaataattactcgatcagcatcatatatatcatggcatatagaaacaatattatccataaaaatatcataatcatttacttcaatcaatctgaataaatcacgataactcatacttaataatcttgctcgaatttggtcattacgtaaaatatcatcagctaccagcttacgatgaaagtcctcatagttatcaaaaccaagataatttaaaaatcctaggatcgttcgtggatcaagatcactttctttacaaacttgtgcaaatgtatattcaatcattcgatgataatttgcaattacaaaagtacaaaattgatagtaaccgtcataaaataaagtgccatttaaatacttaataattcttgataacaatacatcacccataacacaattctcccttcaagcaaatatttacttttctacacttatactataacaatctttgttgtcaggcgatattaaaaaagaaacattgaaaatattttttcaatgtttctttttaatttaaaacaatcctgttataatcgttacattcattcgtcatggtttgtcattttcaaatatgtttctgttttatatttaacatttttatcatagtctaatttaaaataacatgtataaatgcaatctaacaaataaagtaatgataaccttgttgaaaatgaagaaatcttattataatgattttcatatggacttaagtaaagattataatcacaaagactaactaatgactttagcgtcgttgaagaaattaatatgattggagtattgttctttttcaacaatttaacaattttgtcaacaatcattccccgtccttcaaagctaacaacaattgcaatatgttccttgtcacttgaggcagctgctaaaagctgttgatattcttcaaccggaacattaacaaaacgaccgatttctgacatttgaaacttaaagttttcaacaaagtaaagattaccagctgaagtgtacatatcgatgaactgagcattttttagagctgaagcaatcagtcgtaattgatccaagtcaattagattattcgaggcaatcaaagtctgctcgtataattctttcattttcattgtaatctgatactgcgtctcattttgtgaaaatggatagttataatcaattgttttcttttctttcaaataatctcttattgatgttgataccattactttaagctgtgctaaaccattaagctctagttttttacacagacgataaatcgttggtattgaaataaagcaagcagcactaatttcatcagcactcatattaataaagcgttctggattatttttcatataatcaactaaagtctgttcattggtagttaaatctgttaaattatccaatcgactaaatatattcattttctcagcccccttatcctcgtatcattataataacactttgacacataaatttcctaaataaacaaataataaacataagctaacactcagtaaaatatatcctcccgccatcaaaaacttaccatcactaagcagattcatactttctagtgaaaaagttgaaaatgttgtaaagccgccacataccccagttttcaaaaataaaatccagcgtgattcaagattatacttacttgctaacgctacaactaatccaattacaaatgccccaatgatattgatcatcatagtcataaaaggaaaagtagtatctttaattataattaatcccattaaatatcttgatacagcaccaataaagccaccaattccaactgctaaacattccaacataattatctcctctatataatcttattttatgattattcaaaaatttaagcaagtaaaaaagggaagtttacttccctgccaaataagcttttgcttcatagcttcttaatatttgttttaaatcatcttcataattactaatcagcaaagttccttgaataaattctaaatctatttccacttcatctttactataattacaaataactataacctgttgttcgtttaatgttcttcgataagcataaacttggagatgttcttttaaaagctgctgatagtcaccatagatcaatacctcatattcttttcttaatcgcagtagatcacgataaaaataatataccgagttagggtcttttaaagcgttttcaactgtaatatttgtatatttttgacttggagcgagccacggctgaacaatactaaaacctccaaacctactgttatcccacggtattggcatccgagcattatcacgggaacgtttaccaaaataagcaatgatcgtttcttcatcataattctgtttaaaaacttcatacttatttaatgcatcaacatcgcgatactgtgtcattgattgataatatgcatttgtcattccaatttcttcaccttgataaatatatggtgttccttgcatccaaaacatgaataatgctagcattttcgcagatttttcaagataaaaaggggttgaatcatcaccatatttagaaactgcacgtgggcggtcatgattatcccaatataaagcattccatgctttaccattcaaacctgtttgccaccgttcaaaaactacttttaaatctgctaatttaggacgctgataagttaaatttggtcctttatctaacgacatatgttcaaactgaaaaatcatcttcaattcacgacgatcaaaccctacatataatagagcatcttctacactaacatcagctgtttctcccactgtcatcgtatcatatttagctaaaacacgatcatgcatctcttgaagaaattcatgtactcgtggtccattagaaataatttcatacatatgcggatcattaataatggctttatccattttttcaaaatctttagatatttggttaataacatccatcctaaaaccatcgatacctttgtctagccaccactccatcattttatatacttcatttctaactttttcattttcccaattcaaatcaggttgttcctttgtatataaatgtaaataatacatttctgtatcttcatcatattgccaggctgatccctcaaaaaccgattgctgaagattaggcggttgatcatttttcccctcacgccaaatataataatcacgatactcattatctttagatttacggctttcaacaaaccagcgatgcttaaatgaagtatgatttacaactagatccataataatttttaaacctttttgatgtgcttgtttcaataattcttcaaaatcagccattgttccaaaatcagccataatatcctgataatcactaatatcataaccattatcataatttggtgattgatatactggacataaccaaataacatcaacccctaaatttttaatataatctaaacgactgataattccctgcaagtctccaatcccatcgttattactatcttgaaaactccgcggataaatctgataaacagcagcctcctgccaccaacttttttgcattatccttcacctcttttatatttaaacataacaaaaggtcaaaatcttggcccttttatactataataggcaaaattttaaccttttcgatattttgaaggaatatcgtgataatattctttaaatattttattaaatgctttcacatttttaaacccatgatttaatgcaatttcattaattgtgagactagtattcatcaaatcattataagcatgatttaaacgaattttattaatataagataataatgtaatccccgtcttttccttaaacattcttgataaataaacctcactaaaatgaaaatgattagctaaaatcgtcaaactcaattcatcatcataatgctgttcaatataagtgacgatttgtttaattatcggtagtttcttttttgtgattgccaacttataaacactacattcttccagcagcagctcatatatttgcatcattcgattatgtataactaaagtttcttgatcaagatgatcacctaaataaataattagctgttctaattgctcttgatcctttattaaagataaatcaaattcacattgtaccagtttaaattcatcaaataactcagttgataaaagtaatgttattattttcgtttgatcctctaaaaatcttaatctatgaatactattactattaatcaatactaactgcttagtattaacaaacttcttttccccattcactgatagttcaaaagaaccttgattacaataaattaactctatttcgtcatgccaatgcggcttcattactttactgcgattaaactgatgattccaaatcttaataggatatttaaagctagtttcaacaacttcatataaatgctgcattatcatgcctcacaaaaaggattgcttagcaatcctcatcttctttcccatcccaacaatatgtacataatttacatttatctaaaccgattgattcgatcatgtcatctaaacgatgataacgcaatgatgtaaatttagagcggcgacgaatttcctcacacatatttttatatctttcactatctgggtcagcgtattcttttaaaatctcatcactaacattatcaccttctagtttttggataacacgacgagtcactaaatctaattctgaactagagcgtgaaaaatttaaatatttacacccgaacatgattgggggacaggcaggacgaacatgaacttctttagccccactttcatataaaaattctgttgtttcacctaattgtgttccccgaacaattgaatcatcaatcaataataaacttttatttttaattaattctttaaccggaattaatttcatcttagcaatcatatttctttgactttgactagatggcataaatgaccgtggccaagtcggtgtatatttgataaatggacgagcaaagggaatacctgaaacatttgaataacctactgcatgggcaattcctgaatccggtaccccagcaacgctatctggctgtacatcatcacgttttgctaataaattaccacaacgattacgcatacattcaacattgattccctcataagttgatgttggatatccataataaacccataagaatgaacaaattttcattttatctccaggaccttgtttaacttcaattttacttggtgtcatgaaaacaatttcccctggtccaagatcacgataatgatgatatcctaaatttaaaaatgcactactttcaaatgtcgcacaatatccttctggtttttccccaataatcactggtgttcttcctaatttatcacgtgaagcataaattccttcagatgttaatatcataatactcattgagcctttaacaacgtcttgaacatatttaattccttctacgatactatccttttgactaatcaatgccgctactaattctgtaggattgacttcacccgaactcatttccaagaaatgagttgcccctttagcaaaacaatcatcttttaactcttccaagttattaattctacctactgttgtaatggcaaaagatcctacgtgggatctaaccaacaacggttgtgcttcattatcagaaatacaaccaattcctaagtttccttcaaattcttctatatctttttcaaatttagttcgaaacggcgagttttgaatgttatgaatcgatctttgaaaaccattatttccatgaactgccattcctcctcgtcttgttcctaaatgggaatgataatcaatcccaaaaaacaaatctaaaacgcaactttcttttgatgcaacaccaaaaaatccactcatttatatctatcctccaaactttatacacccattgtatcttatttgtaacaaatttcctatatttaatcttattttcgctaaaatattgcccaggaaataaagaaaaacctgttataataacaggtaaaatatcaaaacatttgcttatcaatactattatctacaaattctaataaagaaataattacttcttttaactcatttgacttctttaaagtttcttggtcaaaatgtctttccaaataatcatgactaccataatagacttttaaactaccaatagaattagtttctagatcatttaacccttcaaaatcagctatttctagattaccaaaaagctgataaacaagatttcttgctacttcatcattagtttctttgattttatcatcttcttttaaatactctgtcctcattttataatgagacgcttctttcaacaacgttacattcacgactattctatctgaggtttctaagcacaaagaaattagcttatgttctggcaactaaattcctccttcactaatactaaattatatgaaaattatatcttattataccccattagttagataataatcataaaaaaactaggtataagagtatacctagtatcaaatatatttctatcctatcaattcaatatttttttaatcttattttattagctgctgactacctttataaatttcttgggttatcaagattatattctttagcaatttttttgaaattatataaaaggtagcgatgacgtactaaatcatccggcttactacgatacaatgttacaattccataaggatcctccattacaatttgatgattctccaatgtatcaaataaacttaatgcatttctttgatttaacacttcaaagcgacatatattattatctttagtaattatatctaaatcaagataaaatctaaattctggcatcggccatgaaattattgatcttgaacacattgagatttttgtactcttaatttcaccgtaaggaatttcaatctcctcataattagtattattgaacctgacagcatccttatcgaaatttaaaacacgattacgtaatgcagacgcttcatcatattccaatccatcaaaaattgcataaacaatcaatcgtgcagtagtagattttttgggctcaaacgtctcaacttttacttgactggtagtattttcattcttcctatcttctgttttttcgccaacagaattttttatttccctctcttgaaattcttttttagattcctttttaagattattttgaggattaaacaattttaataaactatcctgtgttgttatcttaacaatctcattaaaaaaatcaacttgactgccattttgacaatcaatccgattaataatttgtccatcacgtaaataaagaaatttctttgcataactggcaatcatattatcatgagttactaagataattgaggttccttgttgattcagttctcttaagatttctagtacttcatgtgaatttttagaatccagattccctgttggttcatcacaaacaacaatttttggcttcgttactattgctctagcaatagcaacacgctgccgttctccaccagaacattcatttggctttttatatagagtatggctaatatttaagcgttcaccaatctcattaacgcgttccttaatttcttgtggagaaacttcatttaaaatcaaaggtgtagcaatattgtcaaaaacagataatgatggaactaaattgtgattttgaaaaatgaatcccaaatatcgattacgatagtcacttagttcagcatcattcatctcaccgacaaaacgattaaatattttaactgctccactacttacttcatctaatgttgataaacaatttaataatgttgattttccggaaccacttggccccataacactaataaaatccccttcctctaagatgaaatcgacatttcgcaatgcataaaaattagcgccacgttttaataaaatatcctgatcatatattttactaatattattcgccgtgattaagatatctgacatcatcgtacacctccttgattaatttacgataactgacgatcatatatattgacataaatgtatataaaataatataaattgcaatcattgtgataaaagtattgtaagtaatcatattaactaaataactttgatataataaggatccatacataacaattgggaatatcacaattaaaataataaacagcatcatctcttggtaatgaatcttaaaaatactttttttgttgtaacctaaagcccgcattgttgcaattactgaagctcgggttggcaaatagatcataaagcgaataataaaacaaaggaacattgacgccattaatgcaaaaaaactcatcatcattgcattttgcacgtcaatcgaaactgactgcaagaataagaaactaataattattggtacaacaacagctgaaatattgatcattgctgtcattacgtcagtaagatcttttagattactaagtgatatgatccagttctttgattttagtaagactttattatgcaataagtcaaataataaaggaaatgtattatcaatgatgaggacctcacctaataatgaaaaagcaaaataagtaggtaaattattattttcaattgatcttaacattggcgtaaaacctatatatattagtaatattcctagtattgttgataatatttttccttttggaagcatatcaatagtttttggcttttccccctttaaagctaaaccacttgacattaatttaaatggattaaaattagttgtttttcgtggcacatgattcatatagccagcaatatcagttttgatcctcataaattttcccatatcaataacgaccacatagatcatttttgttaagaataaagcgccataaataattaaaatattcgttaggtcaactgtaatcacagcatcataaatagcactatacatataaacccaaccccagccaattaaaaatccaagcgcataggaaattagaaatagcaatccaaattgaattaaaatatagcgaattatctgcttcatatttcgaccacaaagcagtaataatgaaaactcctcgtttttattattaataatgtaattattcacaaacaaggtcaatgcaaatgcaatcatgattacaattcctgtgactaactgcagaatatagccatttgcaaaatccacttcaatattactagttgaatacatcacaaccgaaatgaattcgaatgatgataacagtgataaaactgctaatatccctaaatacagttttttctgcccggaaataatttttttaataaatgtaatcatttccaaatcctcccttcactaaattctttatctactttaagtatacgcttacattttttaaattacaaatattattataattatttttaagtgaataactattatttatattaatcatatgtaaaaaaagtaattaaattcatcttttaataaaacagcccctacaaatgatacatatcattcatatgggctaactatttttatcaatcaatttttcatattcatttataggcattggtttatagtacacatatccctgaaccaaatcacatcctacttcacgcaaaaattctacctgcgaaacttgttctacaccttcagcaaccgttttaattcctaaattattgaccatcttaataatatctttaataattaatttaactttatccggattatctgaatcttcaaaaaaagcactatccaactttaaaacatctattggtagatctttcaataaatttaatgaagaatacgcttttccaaaatcatccatagaacaaataaaaccataatttcttaaatcattaataattttaattagtaaatctgttctttcaaaagcaacactttcagtgaattctatctcaatcattcgatcgggaataccaaattcttgttttatttggtaatactcattcacaaatttagaattgtaaaactgcactttagatacattaaccgaaacaggataacatggtaactcttcatcaattcgttttctaatccagctacaaacttcacgatatacatatttatctatctccttaatatgcatatttttttcaaaaatagggatgaacagatcgggataaatcaatctatcttcactcttccagcgaactaatgcttctgcacatgcgattttaccagttttaatattgactttaggttgcaaatatacaagaaattcttgattgtctaaagctgtttgcatcctattttcaatcattttctccatatgcaatttatttctaattgcttcagtataaaaagcatagtgttcttcagaagttctttttatagtatcttgagcaaaaatagcacgatcaatgtactcatcgatagtaagtttttcaataacatcttcataacagcaaataccacaacaaagcctgatttgataaccattctttgctttctttacataatcaatcaaaatttgatcaatttctatttgtttttgttttaacatttctttactctcataatgacgcaatataataaaactatcagcattatttcgagcaaaagtttcatttttatcaatactatttgctaatacagctgcatacttttttaatattttatcaccaaattgatatccaaagacatcattaatatacttaaaatgctctatatcaatatacaaaaaagcaaattgaccttttgttttcttaataatatttcttgcctctaaaacaaatttaagtcgattatttaccccggtcaagttatcacggtaagctacgatactcaaagtattatttttgcgttgcaatgttatcatgcttcgtaaataaaaaataattattatagaccatgtcactaatgaaattcctgataaaatcatcaacatcattaatagataattactttgtgtcgtagtataatagtcaactgcaaagacagtatcgtttgctatctcaaataaatcttcactatcactaagcagtttctcatgaccatttccttcgcgtactagaactatatccatttggattgcttcccaaatattttttaatttatttaaatctgtccggtaatcttcatcatcaagattaattagactatatttaccaactcccatatctaactctgtaagaatctcatcaatataatcttttaattcgtcatttggctgatcagttaattctaatttgaccaaacgctggctcgcaccacgaacaatcccaacataattaatcaatgtcccataatcacgaattttatataaagtgtgaactgatattgagcataatagtattaatgttaataaaaaagcgggtaaccccaatctctttagtctcatctctatcacaccctatcaccttaatgatatgctaatcattaggataaaacaagcaaatgccctcatttttacattttttgtaaaacgcttacatttttatcaagtgatttacacaagaaaagatttaaatatcaaatttttacttttataatacaattaacatatatgtttaaaacaactagttgcaaaatatgattgaatggagaatatcatgaaaacaagaaacttaatcgcaacatcatcattagcacttacaatgatgctaggaatagttgccacccctttatcagcacaacaaacatacacacccggtgtgacggtagagaaaaatactaatccaaaatgggaagcagactatacagcaaccttcatttacaaagataaagatgcgcgtgatgcaacaaatgttagcgtaagcggtggtttccaattttataaacccgaagaagtacagtcatttgcaaatactggtgacggggctaatatcccatgttataatgcttatcaatatcaagatggaatgttcgctggagggtacaatcttaatggtgatgccgcaaattattcaatgactgaaattgaagatgaaatctttgaggtaacgatccctttacctgcaaatgaatacttttatgctttcaatattgaatattcagatggcagtagtgaaactaatgtcaaagatcctgctaatcccgcacttgctaatgatggttcagatgctggatggagcctattttatgtaggtaatggtgagactaaaggacaagaatatatcagccctcgtaccgatggtaaaacaggtacttactcatttgtcaattatttagctgaagatggaactactcaacctttaggaatctatctaccgaatggttatgatgctaataaaacatataaaacaatctatgtttctcacggtggcgggggtaatgaggtagaatggatgactattggtgcagttccaaatatcatggataatttaattgctgatagtttaactaaagaagcaattgttgttacaatggataatacatacttcaattgggactatgatcgtattattaataacctatttaataatattttgccttatatcgaaacacattacaatgtatcaaaagaagtaaacgatcgggcattttgtggattatcaatgggatctatgacaactacgactttataccagacccatcctgatcaatttggatattttggctgcttttcaggagctaatgttccagttgatgtaagtaaagttgcacatcttgatcaaccaaacttatatattactgctggctgcatcgatatggccttaatgaatgatagttataatactgcgagcgatcgtactacaactggattcgtagataagctaaatacattaaatctaaccaattacaaattagaaattttaaatggtgctcatgactggtacgtttggcgtgaatcgttcactaactttgtaaaagatcacttgtggactaaagatgttaagatagaaacgcctagtgaaactcctgttattaaaccagaaacacctgcttcatcaacaaatactactactgcacctaaaacaggtgacgatttaaatcttgctgttgctggattatttatcatcatctcagtgacaactggtgtagttataaaaaaacattactaaatacaataaaaatcgtaagttcatgatatctcttaacaaaaaagatatcaaacttacgatttttttattactcgtactttataaattaattcagaaataatttgacttaaataaaataacgaataatagccatcattaattgatttaggaatgccatattgataaatataatcaaatattttctgctcagctaaatcatcttgagcaaaaacaacaagttttaaattcttctgactcgctttctctactactcgtttttgaatttcactataaaaatcattggacacatttaacaaaaccaaagtatctccatctttaaaaaaatcactatgaatatcttgaaattcctgtaaatcaaataaatatgcaggaacttcattcgccaccaaatctaactgcacagtataaaagtcaatcatttcatgagtatcaccaataaatgtaacactacggctattaagcaataatttggttatagcaacaagtttttccatgtccaaattaagttttgtctgacgaagattgctgatagcttcaacatataaagaatcagctaaattatccaatgatgtacgcataaactgctgcatattagataccgttcttaccatatttaaattacgaataaaatagtctaaaccatctttaaaatcctggaaagaactgtatcctatcttttgaacaaagcgactaaccgaagcaatagaaatatttgcttcttgagcaatctgctctaatgaaacggttttaatatcaccaatatgttcaatgataattctagcaatattgtattcattagtattagaaagattttcattacaatatctaaaaaaattaaatcccaactgctcgtgtctcttcataaattccctccattttttatattatatcaattaaatatcttaattaaaaggaattctctttaaatgtctagacacataaaaataaccgggaccggttatttttataaagacatacttttacggtcaaaaattattccacctcccccataacaaacaatcattactacaagtaatcctcctaacattaaataaccttcattattaccgttaatcaatttttgaggatcaaataaagttaataatgttgcaaatttaagtccttccatacttccttgcatattcgaaagcatttgaatcataataaaaactatcgggattcccgctccaaataacgatgctaagcggtactcattaaaaatacaagaacacatataacaaattcctgttaatgttaactgtaaaatgaaaactcctaaatttaaaaccaaataagctccaatatccaaatcaccaggaaacatcaaagcactacatccaagccctaaacctgtacaaaaagcaattaaaacaaataagtttgttatgataaccagcatttgtgtaaaccacacagatctactctcaacgccactacataataaataactcatcacaccattatcaacttttcgaacaactaaacgtaatgctagtaaaattccaaaaatcaaaggaaaaacaatcatgattaaaccatataaataagtagagagaaaatcaatcagtgttgtcggggtaccactcattcctaccattgccattatttcaggcatacttttagcaaatgtttctagcgctgttcctagcttaggatcatacattgctaacatgatcgttgtatacattgtcaaaatcaaacaaaaaataactagtatcttataattagatttccattctaatttaaatagcgctttattgaacatgttgatttcctccataaaattgcataaaaatttcttctaaactttggtgtgcaatatcaaaattcattaattcgtagttatttaaacaactgatcaattcattaatttcatgctttattacaacctcaacaacattatcatcagcatttctaattgtaaaagattctttttgaaatttgtaagcatcttgatgatttttaaatgttattatatatatcttttgtttcgatttctttaatgtgtcaatatcctcaatactcaccattcgtccttgacgaataattcctacccgatcacatgttttctctacttcttcaaacatatgtgaggacatcaaaatagtcttaccacgcttcttttcttcaataattaaattaataaactcactttgcattaaaggatcaagtccactagttggctcatctaaaataaaaacagctggatcatgcataaaagctactaccaaacctatcttttgtttcatcccttttgacatctttttgatttttacatgaggatcaagatcaaagcgttcaattatttcttcagcacgccccaaatccttcattccccgatactcagccataaatttaataaactgaattccagtaacctcctccattaaattaatttctcctggaatataaccaatcttcttttgaatctctgcaattttcttactacaatccatcccttcaattaaacaggttccttctttaggaataataaaccctaacaaatgtctaattgttgtagtttttccagcaccattaggtcctaaaaagccaaaaacttcacctttttcgattttaaaagagacatcaaatattcctttatcattaccataatcttttgttaaaccattaatctcaacaacactcatataaattcctcccgatagaaattctcttttataatatccaaatatctaaaatactcatcttgaatctctttcatattaacattttctaaatcctgatatctatccatatatccttgcgacatccaataaattatgttccaaacttcttcaggatcaactcctgctttaaacttactaatatcagcacgtttaattaaattatatgatgctattacctctgcatataattgttcataactatttcctactatttccttacgattttggtaatagcgcagtgaaaagccataaatatatggatatttagacatcatttccattttgcctaacactgctaatttaattgcatcaaaaaaatctttaccatctataatattcattttttcaaataacttcatcactagtctagcgctatattgtgctaagtactgatacaactctagtttattgtgaaaataataaaacaatagtccctttgatattcccgctttggctgcaatatcatcggttaatgcatgtttataatcatttttactaaatacttctaaccctgcattaataatggccagtcttttttcttcgtttaattcaaagaatttttggttcattttatcacccctttgactgacttgattaattaaattatagcaaattgactcgtttcaacaacccctcgtatcaatctttatgcaatcttaatagtccaaaaaataaagaccaaaatgaaatattttgatcttttcatcatcctatcttactaaactcttagctaaccaaatatctggttttcctaaaccattggcatcaggaatcaccccaactatttgatatcctatcttttgataaaactcatagggatgtcgttcaagattcctaatattttttatctttgaatatagatcatcaaataaattagtattagccaatgttgttttatcaaattcatcatcactgcctaaataaatggtacagcagccacaattcttaagctcattttctaatgctgtacaaagctttgtaccaataccttgaccttgccactttttagaaaccgccaaaggatgcaattcccaagcagtgattccatactggggaatagccccaaccaaccccatcaatatatcattttcaactgcccccagcattattctatttgtcgataaacattttgttatttctagctcggcacaatctttatatgcatatggaaatgcttcaatcaataatgtagctgcctgctgacgataataggttaaattagatgttaacttaattatttccatattttcaccccttttacttatataataccatctattttactttaagctgcttaattcttatttttatattattaataatataaaaataggctgtaactaaatagaataaatttattctagaggggttatacctcttttttatttcaactgtttttggatattcataaatgtaatgtaaatatctttatttttaactattataaataattatttctcttttcgatactttctatgttggttttcaagaaatgtgatactagaataaaaactgtaccagttaaatgaaaaaaagcaatcagcccttcatgcctacaaagctcatatcactttcctttcttaatagaactgctagctatcatatagatttacctcaaaagtattctaacaaagagtccagtttttagctatttaaaatacttatttattaaatcatttatatacatatcaccccaatatcatatttcctgcaaaacaggcattaaagactcccccgctttgaaagatagtattctacttttggagaaatttaaggatattcttttcttataatgaaataatcagcctcgagttcttttaattgtgtacttaacattttgtgtgatatagtccccaatggacgttttaattcactatatcgcattaattcagttttccaaagctaaaataaaatattcatcttctatttgccacctataattgacattgtatattcaagatggttttgaattaactgctccatttgtttacatctatacttattttttcttccattttaaactctccttttagatagtatcttacctaaaagtgcatactgttatttttgttaaggtagtgctatattacacttaataaaaagaaaaaaggagtaatgatgatgagaaatttagataaatcaatttcaatcaacggattgacgttaaaaaacagattagtaatgcccccaatggcaacatcaagtgctaatgatggtgaagtaagtcaaagaattcttgattattatgataagaaaacaaaaggtggatatattggattagtcattactgaacacagttacattgatattcaaggaatggccaatcctaaacaaatgtcagtagcaaaggatagcgatataaaaggattaaagcaattggtaaatataattcataacaatggaagcaaggcgtttgctcaaataaatcatgccggttcaatggcaagaggaacaggattacctactgttagtgcaagtaatacaataccaataacaatgaaagaatccaatatcgaaataccagaagaattgagtaaagaacagattcaatatatagtaaaaagatttgctgatgcagccagacgcgtaaagttagcaggttttgatggggtagaaattcattctgcacatgcatatcttttaaatcagttctattcgccaataaccaatcatagaacagatgaatatactggtacaacacttgaaggtcgattgagaattcataaggaagttattgaagcagttcgaagtgaagttggagaagacttcccaattgctttacgcttaggtgggtgtgattatatggctggcggctcaacaattgaagattccattaaagcctctcaaatgcttgaaagttatggtgtagatatccttgatataactggtggaataaatcgctatatgattccatggaataaagagccaggatatttttcagatatgacagagcatattatggaaaaagtttctattccagttattttgacaggtggaataactaatgccatggatgctgaaaaactactgcaattaaacaaagcagatttaattggtgttggtagagctattctaaaagatgatagttgggcaaaaaatgcaatggaacaaaaataatgcaaatactggtatctataatacaagtatttgttgaattacgatacaataaattcggagatgaatactatctccggaaatgcggcaatgacctctaaaaaatttaaaaagaaagtaagaaaagtttccaagaagttaggaaaaattgcctaaaacttatatttaaaaccatttttaagatggtaattcttctttaccatatcatatttattattaatttaaaatgtattttgaaattataaaatttattacaattaaaaacagataaatttgtatgtacctaagaaaaacattattcattaatatattagaaaaattataaaggagaagatacataccttttatatggggctttgaatataatggggaattgattacttgtttgaaatcacatgccataagatttataagataataaaaataatgtatttttaagtatatattttgatatttaatcttatttaaaatatagattacagtgtatatgaatagcgatacagctgataaacaattatttcttggattttgggattaatataataactatctttttcttttgtgagtaaggtagttattttttctataattatctcaaagagtaatgttaccactatcgctataattacgattttttgatattattttcactatataatttctaaataatcaaaaaagacaagaaataaataccatgctataataagtactgaaaaagtttaaattgtaatgtaagtttactattttaattttggaaaattattcagtatatttgggacataataatataatgggatatatttttatcaattgctatagtattttttaaaaggaggtaaaaatgaaattaatattaagtgataaatatctaaatcttgacgtatcagatcattctaatacaaaatttatagatctatcatcattaaatatagctaactgcactggatgctttggctgttggactaagacaccggggaaatgtgttatacgtgacgatgcaacaaaagtatatccgtacattgccaagagtgataatttaatttatatcagtaaaatattatatggtggttatgatacccctatgaagacaatgcttgaacgtgcaattccgattcaaaaggcatttattagaatactaaacggagaaacacatcatgttcaaagaagtgtagaattgaaaaatgctacaattattgcctatggagaaatagacactgaagaaaaagagatatttaaagctctggttgaaagaaatgctaaaaacatgaattttaaacactataaaatattatttacaaatgaacaaaacctagaaaaaactgtgaaaacggagatgataaaatggagcgaatagtgatattaaacggaagtccgcgagcacctaaatcaaattctaaatgttatgcagacattttttcaaaaaaatataataaagacattgaatattacaatataacaaagcaaaatcatgataaattatgttctaaaatgaatgatttctccgatatgttactggtttttccattatatgctgacgggattcctgctacacttttaaattttcttaaaagtcttgaaaacaacttaccagataaaaaaccagtaatttcagtaataataaattgtggatttttagaatatacacaaaatgatttagcagttaaaatgatagagctgttttgtaagaaaacaaattgtgagtttggatctgttttaaaaattggtagtggagaagcaatcctaaaaacccctttcaaaatatttgtaacaagaaaagtaaagaaattagcaaattcaatcctatcaaaaaactataaaacactccatataacaatgccgctcaccccaaaattatttattaaagcatcaacaaaatattggattaaatatggaaacagaaatggtatcacaaaagaacaaatggatacaatgagtatagaggatgacaataccttagtttaacagctatatcaaaaaggagctcttatgattttaaatgtagttagttttgatgaagctgcgctccatgttcttttatactagcaattattcatatattgtgtttttggatagaagtttagagtgtttatcgagagctcaactagattatattttacatcaagtccaaacagcccaactaatttcaatatcttctgttttagaattttagtcccattttctattagctaatctttatttgaaaatctcggagcatcatccttagcatctatttgaactttttgtacaaaataatcattattttcatctattaaatcaacaataaaattatatattccatcattatactcagtaatattctttttaatagctttatgcattaaagaaaagaactcaatatagcttatatttgcagtaagtattaatcctatacaatcctctatattgtttttttgtattatgtatgcctacaaaactcatattgctacaatccttttttaataaataatcagctgcatacattatattaccgccaattgtattctatcaaaatatgtatttatttactgcttttagaatattaaaacaaaaaatctctttagttttgtttatctaaagagaaattttatattataaaaatgttagcaaattttaaagatgcttttgcagcagatataacaatcataatattttttctttatctgtaagctagattaatataatatatggaatgataactactattttatactattcagttctatcttagtattccatatcgatgatagtcaaattagtctgaatctgatgatttcaaacaatgtcaaactgcaacatttttaaaattgtcatatgcattaaattatatatcatttattatcatacctaaagacattcttcgtcaaaatgataaatccttaattgattttacacaactttttgatatcatgcattaaataatccttctctattagaggcttgaatatatttaaaatattatcatctaatttattcaaaatctgaatatagataattggatgatagtcagcaaacataatagttgatggattattttttatgagtgacaaaattgcattgagatttccatctgaaatatcaatactatgttttgtgcaaatcaatcttaaatcttcaaaagacatttcttgtatcttgtgattaattgtttttatggtatcattcataaacatcatacctccttgcaatagcagtgcaacgaaaatgtctttatactttaattatactaatattcaataagttgtaaatttatataataagattttgtttgatattcaaaacaaaattatcaaaatagaattaagaaatatatataaagaaaataattttaccaataccatcaaattaagatgacaacattttaattcaaaggaattatctaaaattaattgcattgaattgttatttttttataaaaaaacatatgataaaaagtggctgtaatgattgtgtagttttttagctattttagagtattacagttctttttttgtaaattaaaataaatgataaaattttagcctttttactctgtcttttcctcattaatttactgttttttgacgcattttaaaagaattaccttatttttgaaaaaatttatatctctaattttacacctgctggtgttcttttaggaagctttccatagattgcttcatatttttcatcgatggtatatatgtttttaaatcattaccgttacgctgatatatataattcttataattccatcacttatcccaaattggatattatattcagatttaaatacatttgtatgcttatagtaatcgtattttatatgcataaatgttacatcaagatctattttgaaacagctgttacggtttcccggcatatctatatgaatagtatattcccatcaaacattttgtgataaaaacagattggttggattaaactattgcgtcacaggcaacgtgcataacagtgtatcgtttttccaacgtatgcgttactaaatgaagaatataaagataggacaaaaaatatatgtttaaatccagaatatatcacactgacaatttgtaagacgatattagaaaacaaacaaaagatgtatgcaccatataaaagatcaatcacaaaaaaagctacattaaaaaatatgaatatgtatgtcccaacataaagattttagaatacagcgctacaaataagttaggatataggaaatacaaattaaatccatagaattgcaaaaaacatcacaatttgagatatacaagagtaaaaaggtcttaaggagaatcagcatcaaggactaatgatttttgcgtatcacattctaaaaataatagcaagataggggaacaacactgtatgtaatccaaaaacgctatttttctataagttagtcaatataaaaaaagcgatactcgttttggagtatcactttgtcaaaagtctgaaaaagcgttcatcatagagtgctttttgcacaagacaaaaccacaacataattatttacccgttacagcctctttcttaatatttctatattctttaatgtatggatcccgataaaaagaataagctaactgtaaacacatacaacaccaaattaccggttcacaaataataaccccaaaatatcctaacaatggaataaacagccaaacaaatactattttcccaataaattcaattatgcttgaaactaaaggaataatcttacgccccaatccctgtaaagaatttctaagattcaataagattcctaacatacaataaaatggagcatttagcattaaatataatgaaccattatcaattactactgcactacttgaccctgacaataattgaactagagttggggcaataaagaataatacaactgttgcaataacactccaccctactgcaattaaattagcataacggaccccttgtcgaattcgcaatccttgatttgcccctttattttgtgaaacaaaagtagatagggctagacccaatgttgctgcaggcatcatacaaaaactatttaatttacgagcagtaacatgtccagcaataattaaataaccaaatttgttgatggcggtttgcaaaataacagttcctgtagaaacaatcgacatcattaatcccatcgaaaaaccttgccctgccaattcttgatatagttccctgctaattttaaaatgctctttgtgaggaagcaaaataggacattttttataaatataataaaaacaaagaattgccgaaactccttgagcaataacagttgcaatagcagcaccttgaattcccatattaaattgagtaataaataataaatctaatcctacattcaagactgaagaaataagtaaaaaaacaagcggcattacactattgccaattgctcgcaataatccagcacacaaattataagcaaacattaccccaacaaaaatagtaatcataaaaatataatcatatgcctcattaattatatttgctggtgtatttaataattctaatagcggatataaacaaaactgtgaaaaaagcattaaaataatagttaacaagattcctattacgattgatcccgcaactgatttttttaacaagttctcatctttagcaccaaaacttcgtgctgtaacaatacttaatccatttcctacccctaaagcaaaaccaactaataattcataaatagcaccacatgctccaattgccgccaatgatgtatcccctaaaaagtttcctacgatcatcgtatccatggtattgtaaagttgttgaaaaacattagccacaaataatggaaacgcaaagatcaacaatgattttaaaattggatctttggttaaatcaactttcattttaaacataattttccctcttttatctattataactcatattattgtattcctattatcgccacttttcaacaatatcccttttcaaagaatgaaaaaaccaagttaacacttggtttataatgtcgcaataaaatcttttaatatttcgtaacaatttacaaatgatgcaacttccatacgttcatctggagtgtggatgtctgccatattaggacccatcgtaataatatctagcgctggcatctttcctttaaagattcccgtttctagtccaccatgagtagctacttcttttacttctgctccagtacgtttaaaataaaatactttaaataaatcacgtaattttgaatgttggtcgtaattccaaccaggataataatttgctggagtaattgtgccaccaaaggcatctgcaataatatctaattcatcaaccatgttcatcacagcgcttttcattggtgaacgtagtaaataatctatttttaattgtttatctttaattgatactacacccatatttaatgaaaccgttgtcaaatcttcaatcactaatgaacgttcgacaaaaccactcttagctgccatcattaattttataatatcttttgattcttttatactcaacgtttgctgtgcaatatcattatttaatgataactcaactttaacaccaggatcactaatttcaaattcttcactaaaataatcttgatactcatctgccacttcctgaagtaacttaaaatcacttgtactagcaaaaacaattgcacattcacggggaatcgcattattttttaatccaccatttagatccactagctggatatctaaatttgccttgatcataccatacataactcgagcagccaatttattggcatttcctttaccgcgatgaatttcacctccagaatgtcctcctgataatccttttattaataatgtataagttggattttcattactagtaaaatataattccttagtaatcattacatcacagcctcctgatgaagttgtgcaaatttctccttcattttcactatctagcccaatcattcttgtcgcctttaataaacttgcatcaaaacctaacgctccatcaagaccaacttcttcggcaactgtaaaaacacactctaaaggtggatttttaacattaggatcacttaagattgccaacatataagcaactccatagccatcatctgctcctaatgtcgtcccattagcactaacatagccatcttcaagatacaaatctaatggatcatgttcaaaatcatgattactatctttattcttttcattgaccatatccatatgtgcttccaacatcagtgtttcatgattttcatatccttgactagcttctttgtaaataacaatattatttaagtgatcccgatgatatctaaaacctttttctttcgcgaatgcttcaacaaagtcagcaatcttttcttcattataagagccatggggaattttacaaatttcctcaaaataataattaactaaaatctctgtgtctaaaacagccattatacctaacctccattttcactatttttattataacaaaatgtttaactaattaacaaatcaaattaaatgatgtataataatattattaaaggactttaataattattttaatttagattaacctgtcattaaatatcacaatcatgtatagcttttaggaggactagccaatgaaaagacaggcattaatactaagcagtatttatttgattataatgtgtctaggttatatttggtgctatccttttttcaaaatagaaacaattctttttgatttgatctttagaacagttttatggtcaatatctagctatggattatatattgtcttgctaatactaaaaaaaattcagtttgttaaaaaacattgccattagcaaaccatttttaataacctgcctcccttacatttatttaattatatttcttgtagaaggattcattggtttagtaatggtttttgtttttaaaacatatgtttttgcttactcttttttctcaatattaactatcctccatgcaatcaaattatctcaagatcttctcaacaattattgtacttattaataatgcaggagtggcggaatggcagacgcgctagtttcaggttctagtgagattttctcgtgtgggttcaagtcccatttcctgtaccataattaatttaaagtttgtcgattgttatctacaaacttttttgtatttatttaatagcctaaagccccctgctaaactcacactaaagtgaaaaaacttttactctaggttactatctgatagaatataagaaaagcgaggtaaataaatatgattagaacacgaagatcagccttcttaaaatagaaaaactaactatatataaatcaaggaattttaggaacatataaaacaatgaatctaagttatactatttttcatttcgacgatgaaactttttctatcctatggagtgaatataattataaatttaaatatttctatccaaattacttaaataatcttaaaacttacggtgaaattaaaaaatatttcctaaacaagaatctgttaattcatttaacttttcctgtccaccctaggtaacattcaatgagtttttttaacaattaatgataagccacattacttattaccaattttcgcaattggtaaatactacaaacaaaatgataaaactcttctatcactatcaattagagtacatcatcaattatgtggtgcttaccatgtttctcattttattaatgaattacaaattatgattaatgaacataaatttataaaggaataatgatatgattgaaattaataaaaaactagtacaaaacttaattaatgaacaatttcctcaatggaaagatttagtaattgaaccagtcgctaaaagcggacatgataatcgaacatttcatttaggatcaaagatgactgtccgtttgcctagtggtaaaggctatgcagcccaagttgaaaaagaacttacatggctaccttatctccaaaaacatttaaccatgacaatttcttcgccaatagctaaaggttatccaagctgtggatatccattttcttggtcaatcaacaaatatatagaaggtgatactttaacaaagcaaaacattaataatttaaatgaatttgctgatgacctagctaaattcttaaaagaatttcagaaaattgatacaaccaatggtcctcaagcaggacttcacaactattatcgtggtggttatctagcagtatatcacaatgaaacaatcgaagctttagaaaatcttaaaaccgttttaccaactgagctgctactgaaaatctggcaacgtgcccttaatgcatcagtatctgatttaaatgtttgggttcatggcgatatagcccctggcaatttacttgttaaaaatggtaaattagcagcagtaattgattttggtgttttaggtgttggagatccttcttgtgattatgcaatggcttggactttttttgaagaagaaagccgacagcgattcttaaaaaaactagatcaagggatgattgatcgtgcttgtggctgggctttatggaaggccctgatcacatataatagcgatgaagcagaacgtgcggaaaatgctcaatatacaatcaatgaaattattaaagatgaaaaaaaacttggttaaatccaagtttttttatcctttttgttcaattttatctaatgctttaataacatcccaacaaaaattatttggttgtgctaattctacgaaatgatgtcgcttgaattgtttcattacatttttttggactccagcaaataaaacattaatattattttggcgacataattctactacatcaataaactcccggatccctgaatcatcgattgaaggtacaccacgcattgaaaaaataatattattacattcatttaaaatctcattaacttttgtaattatttgttcttgatttccaaaaaacaatggaccagccatataaattactttagtcctttgatgatcataatttaactccttatcaagtcgttgtggttcaatatcacttgtttcaatatctaaatcagaattattgattacaaataaaatcatagatataaacactccaattacaattgcaactgtcaagtcaaatacaacggtcgctaacattgttactaagaattgtgtcatacttgtttttattcgtttcgaaaaaaattgtttaatttcatgccattcattcattttccaggcggtcataattaacacaccggctaaagctgataaaggaattcttgacataaatggacctaaaacaaacattgaaattagtaaagccgctgcatgaaaaatactaactaaacgcgtttgaccgccagctttaatcgcaacactcgttctagcaatagcagctgtagcaggaacacctccaaaaaaaggaataaccatattaccaatcccttgtgcaaaaagttcttgatcagcatttaacttttcatttttcatttttccagcactagcaccgcataaaagtgattcaatcattcctaacatagcaatactaaatgcaggaataattagatttgttattgctgttaaatttaaactattcaatgacaaacgagctttaggcaataatgtagatggaatactcccgacctctgctacattaaatttaaatactaaattaataatcaaagcaataataattccagctaatgaagccggaaatatatttccccattttttaggccataaaataataattgctattactagtatcccaaaaaacagtgcctctaaatttacattaaagcctaacatacgataagataagattttttcaatcggattgcttcctttcgaagtaactccaaaaaaattatcaatttgtccagttgcaataattattgcgattccactcgtaaatccagtaattacactagctggtataaatgatactatcttaccaaacttaaataatgaagcaattaataacattaccccagaaataaaactagcaacaaacaccccctgtaaaccatatgtagttgacaatccaattaaaattgctgacattgctccagttggtccagaaatttgatacgatgccccagataagccaccgatcaataatcctgctataatcgctgtaatcaaaccagccccagcatcagcaccactactcaccccaaaagccaaagctaacggcaacgcaaccgcagctacggttaatcctgccaaaatatccattactagcttttgaccattataacctgcaaattcttttttcaaacttaatacataatctttaaacatcctaccctttatcctttcaaaatacttttttattataatgataaatattagtgatttaaagtaaaaaataaatattttactgttttttattaatatttctaacttattataaaaatatcgataaaatcatcaaccataaaaagactactacttctactctaaatacattaaaagaggctataacacctaaaagtttaaaaaactttattccttatagcctcttttattcagcctctccaataatatcaattaatttagccaatggttcacttatatatttttcttgatgatataaaagctttgttttattataaagcaattcatctgtttccaccgtttttaaagtaccatgctttaactcctcagtaactaaaagagtaggtaaaaccgcaaaaccaaatccagccttacatgcttcaatcaggacctttgaatttacacttgtccatttaggatatgctgccaatcctcgcaaatataaacaactatcaataatatctctagttgcactccctttttcacgaagcaaaagatcatgagtacaaagttcttttaatgtaatttcattatccgcaaaataatctggtgcacataaaacgtttaattgataagaagaaaaatctattacaataaagggtcctggtggaactactccctctaccaaagcaagatcggcttctccacattccaaaactgccaatgcttcttttgcactgaccacttgcacctcaaccttaatattaggatagctgcttgcaaattgttttagaatctttggtaaccaaaaggttgcaatagtaatacttgaaacaacttttagaggcgcactcatttccaaaacatctatttgtttttctaagtcatgatatagtgataaaattggaataactttttccaataataatttccctgcaggagtcaatataattgcctttgataaacgatcgaataggacaacatttgtttgttgttctaattccctaatcgcatgcgatactccagattgcgtaataaataattgttttgctgctttagtaaaactccctgtatcaactactgttttaaatattaataaatgtctaaggttcatagctttctcctatcatgaataaaagtaatgtatttcattaaattatatcattttactaatgtatatacaacttatataatcttgatatataaaggagaatattaatgaaagcaaataaactaaaagaccttacatggttgttctttatcaatatttttattagcagctttacatttggaggtggttatgtggttgtatcaatggttcgtaagtattttgttgaaaaaagaaaaattttcaatgaaagtgacttaatcaccatgtcggcaattagccaaacaacacctggagcaatcgcaatcaatcttgcggcattagctggttataaagttgccggtaccattggaactatcgttagttgcattggagcgattattccgccaattactattttggcagttgtttcattatggtatcaagtttttagtacaaatcacatcattatggctatcttaaaaggaatgcaagccggaattgctgctattatcgtggatatcctaataggaatgacaagagctattaatgaacaacattcaaaattattaaccgcgatgattcctattactttcattgccagctatatctttaaagttaatatcgttgtaataatcttaattacaattatcgtagccactgctcaactatactatcgccggaggtactgccaatgttaaatttatttataattttctttaaaattggattattcagtattggtggcggctatgcaatcattcctttgattcaagaacaggtcgtcaataactatcattggatcagtgccaatacatttactgacattatcacaatttcgcaaatgacacctggccctttagcagttaatacctctacttttgtgggtattcaactagctggaattagtggtgctatcgttgctacaattggttgtatttttgctggagcaacaatttcaattatcctttatcttctttttactaaatatcaaaaactagaaataattacaaatattctaaatactttaaaagctacatcagttggtttgatcatgtctgctggtgcaacaattttaattctaacttttgttgaaaataactctatcaactttttagcaataattatttttgtaatttctttattatggttacaaaaaaagaaacctaatccgattgccctaatgattatcacaggaattattggatatttcgtatattaagacaaaacccggttactaaatctaataatgacctttgatttcttatttattcagctagttctaaaatgcctaactaaagattatctttatttccaatgaacattttaacaaaatcaaaaaaaactgcctatatgacattaagaagtgtctaatatgaatggttttggtcttgtctaatttaatatcaacaatccattttttacattacatcaacaaattagtcaatcaatttaatatagataattatctagcttctaaattactttattaataacgctgatattcatatcctaaactctaattaattattctgaatagataaaaataattgtattttttattacaaatatttatcacttctttgataattatcaaaatatttagttttagtatagctttcctaacattattgaaagataacaatcttacttctaatataaatcaatacttgacttcattgaatattgaagataataaatgtatacataattcaaaatacatgaatatctcattattaaataattttccttactaaaccactattcttataattgtgtgacctagttacagaactaattttaaattaaaattataataatcttgaaaatgaatcatagattaataattatggaggaaaaaaatgaatactaatcaaaaaattcttatcgtaggcggagtcgctggtggcgcttcagctgctgctcgtctaagacgtttagatgaatctgccaacattattatgtttgaaaaagatgaatatatatcatttgctaactgtggtttaccctattatattggtggtgaaatcactgatcaagaggctttaaccttacaaactcctgacagttttaaagcacgctttaatgtcgatgttcgcaactttaacgaagttactgctattactcctgaaactaaaaccgttactgtatataatcatcaattacaaaaagaatatcaggaaagttatgataaattacttctttcaatgggagcaaaaccaatcaagccaaatattcctggaatcaattcaaataaagtttttacacttagaaatatccctgatacttatgcaataaaagaatacgttgatacccataaaccaaaacatgcaattgttgtaggtgggggatttattggtattgaaatggcagaaaatttacattcaactggaataaatgtaacgattgtagaaatggctaatcaagtcatttctccgattgactatgagatggcttgtgaagttcatcaacatcttataagcaaaggaattaacttagttttagaaacagaacttcaagctattaatgaagccgataacaagctgacagttactctaaataatcaaactgtagatacagatatggtaattatggcaattggtgtggtacctgaaactaagattgtaaaaaatacagaaattgcaactaattctcgcggagcaatcatcgtcaacgataagatggaaacatcaatcaaagatatatatgctgtaggcgatgctattgaaatcaaaaattttgttactaataaagcaagttatgtacccctagcaggcccagctaataaacaaggacgaattgcagctgataatatttgcggttttgatcgccattatcaaggaacacaaggttcatcaattttaaaagtctttgacttaactgttgcaagtagcggaatcaatgaaaaaactgctagggaattaaatctcaattacgataaagtctacacatattcagctaatcatgccggctattatccaggtgcggtcaatatgtcaataaaagtcctttttgataaatcaacgggaaccattttaggggctcagatagttggttatgatggggttgacaagcgcatggatgttttagcagctgctattcgtgccaaaatgacgggttttgatttaactgaattagaactttgctatgctccaccatatggatcagcaaaggatcctgttaacatggctggttttgtaattgaaaatattcttactgacaagatcaaacaatataattgggatgatgttgcatcactgccccgtgatggcagtgtgattctattagatactcgtactgaattagaatatgcaaatggtcacatcgatggttacattaatattccattggattccttgcgaactcgtcttcatgagcttaatttaaataaacctatttatgtaacctgccagattggacttagaggctatatagcatcacggattttaagtcaaaatggttttgatacttataatctcaatggaggatatcgcttatataatacaatttttaatcaagaacatgatgaacccaaaatcaagacaatgcatcctgcttgtcccatagaaaatccagaaacaattaaaattaatgcctgcggtcttcagtgtccaggtccgattgtaaaattatcagcatcactagaaactgctaaagatggcgatattattgaaattcaaactacggacccggcttttgctacagatctagatggctattgtcgtcgtactggtaatgaactaatagaacttagctgtaataaaggaattagcagtgctaaaataaagaaaggacagaacagtatctcaaacggaaataaaaataataaaaatatgattgttttctctggagatttagataaagcaattgcatcatttattattgctaatggcgcagcggctatgggacgaaaagtcacaatgttctttaccttctggggactaaatatcattcgacgaccagaaaaggttaaaatcaaaaaaaattttatttcaaaaatgtttgcaatgatgatgcctcgtggttcaaaaaaactatcgctttcaaaaatgaatatgggtggtatgggagctaaaatgatccgtactattatgaaagataaaaatattgacagtttagaagatttaatcaaactagctcaagataatggtgttgaactaattgcctgttcgatgagtatggatgtaatgggcattaaacaagaagaattgattgatggtgttacattatcgggagttgctactatgttagctaacggtgaagaatctgatatgtcactatttatataacaaaaggagcttggaattaattccaagtctcctttttatgattgtttcttttttcttaaaattccaattcctaagatgctgatcaataatgttcccgccaatatttgaatagatactgaatcaccagttttagctgctgaagtactatcatcttttggtatctctttttctggcgtaggaataactgttacatcaccttcaactttatcgtttgtatttacatcttcttttatcactaattgatctaacgcttgatgcaattggtcatacatctcatcgacttctgcctgtgcagcattttcatcatcaataattgattctaccttctctaacaaggcttcaactttagtaagactttcagaagtatatttttctttatcaagtttcaatgcagtattaaaaattgatattaaattatttttatcagctttttcaactaatgctgcgactacttcatttaatttattaattgcttcatcaacttcatgtttcgtagcattatcatcattgaaaacttctttagctttttgtaaagtgactgtaagtaattcaattgattgaggggtatatttagctgtatctaattgtttacttgctgaattgattgtttcttccaactccattttatcaacaatcttagtaagtcctttaacactatcttccaactgatcaattgcttttaagatatcttcagatgtaacatcatcatcgttataaactttaacagcattatttaatgcttcttgatatcgcgcaatactattaggggtgtatgatgaaatatctaaatctttatatttcttataaatttcctgtaacttagattttaaagttgttccataaacttcaaattcccatagtgaatacccataatcacttccaacttcaatccctaacatccttacatatcgtcctgttacatctttatatgataattcatcaagacctccatcgccatcattaatatctgatatatctgtccaaacttgaccatcattagaaacttgcactttgtatttctttgcaccgcttccttcccaattcaaaataactttagaaatattataaatatcttgtaagtctacatatatccactcatcattagatttccgattagatacccagcgtgattgctttccatcaactatttcatttgtacctttaccatcaaacgctagcgaagattcatatgttttatttccatctttcgaatcaacatattctgagctcgcattcgaagatttattcaaagctaaatttacatttggattttcaggttctaatacagcttccccgtaaacttcaaattcccataatgaatatccataaattcctccaggctcgattcctaacattcttacgtatctgcctgttgtatttttatatgtcagttcatcaataccacctttaccatctgtaatatgtgatatatctgtccaattctgaccatcattagaaatttgcactttatattctttagcaccatttccttcccagttaagaacaactttagaaatatcgtaatcagcttctaagtcaacatagatccattgtgatgttgctgttggatcatcttttgttcttaaagatacccagcgtgattgctttccatcaactgtttcatttgtacctttgccatcaaacgctaataaagattgatatgttttattaccatcattagggtcagtaaactcgctacttgccttagaggttttattcaatgcaatatttacttcaggcaccactggttcttggtgtaattttccatacacttcaaattcccataatgaatatccgtatttagaagcacattctatacctagcattttaacataccgagcagtaacagtttcattaaatgggatatttgcaattccaggttgtccattctcttctagataaaccttttgccatgtttttccatcttcagagacaagaatttgatattttttagcaccatttccttcccaataaagttttacacccgttaaatcataattcgcttctaaatctatttgaatatattcatcattcgaatttctatttgaaacccatcttgattgatcatttccaccattattttcaaaacttccatcaatagctctatttgcagtataaacattgttataaactgaagaagctgttgctgttttatttaaagcaatattctctaaattttctgcttcaacaagttcgccataaactgaccactggatgatttggtatgatgagccactagaaccatttaattttaatctaacatatcgtgcttcttgattacctaaatctgaaatgttctcattaccaccttgtccatcaattatagtttttactgtttgccacatttgtgcatcatcagaaatctgaatttcataattaggtgcataattatttccccaatcaacctgcatacttgaaattttataaattccttttaattctacatagatccattgatcaccggctgcactcgaaatccaagacgtattggctttattatcaattgcatgagtcggtaagttcaaatcctttattgtacttgaaaatgcatttttattagctgcaatatcctcatctttataagaaccatacacagaaatttcataaatactaataccatattttaaagttcttgatttatgtgacgaaactctaacataacgcccatatacaggttcatcaaaattgtattcatccaataagctacttccagttgccatactatttttaaccgttatccagttatttttgtcactagagacctgaatatcataatcatcagaacaagcggattcccattgaatgctcatagcattaatttctgaatattgtcccaaatcaaccatgatccagttctcatcttcatttcgtaatgaactccatcttgtacttgtattaccatctacaactaattctttagtatttccagggtcatttgttgacgtactgcttgcttcaacagatttattaagcgctattgaatcacttgctttaaatgtaatttccttaatttcaaaacaatttccatttccatctttcatgataatcttaatatatgggtagactccttttaattcaatcgtgtctgtcttaccatcaccattacttacagatttcaataattcataatttttaccatcttgagaaaccataacatcataagcactagcataattatcaccccaaagaatattcatagatgctaaatgtttattattgccagtaaacatactgatccattcattttgcgtttcttcactttgccaatatgtattttcatcaccatcaaaagctttttcgacttcgtgtccaatcattgaagaattagtatgataacgattatctgagccttctgataacgtcattgtttgtccagcatatggtaatgctcctgaaacaaatgttgtttgtgtttcttgattatcataatttaaatttacatttacagtttgattggctgctgtatcattgactgctacagagatttttcttgtatcctctgattcatcaataataatactgcaaggttgatcaacagtaattatatagccatctttatattccaatgaaccagcttgatagaaattaatttgagtttgttttaaaccgtcatgtcttaccgcttgaactttttcgttattagcaattacagtaactggtgtattaccggcatattgactaactgcacctgctgtggtatttggtacgacaatataggcatagctatcattgcttggctttaatccatgatctaaataggctgtaaaagtagccggagtttcattcttttttgcttcatcccataatgacggattattagtttgaacactattacttacaactacatccgtattttctaagaaaacatatccaacttttccattatatagccaattagtgttataaatttgttctttcgttccctcagccacactttgaccaccaacatttacatcttcagcttcgcattgatttaatgttgtatggatattgactccctcagtagaattgatccccgaacctagagcaacaaattcatcatcaaagaagaaatatcctttctttacttgagtcccctttttattcatatcataagcagtatttccatatttaccattggataccccaattgtatgttcagttccatttgtaaaacgacctgcattagcataatcttgaacgattcgtgctgctgttgttgttcctggacaatgagcccaatcatatgttggataaacgttagtatattcatctccgtcaactgtgattgttgaagctgctgatgatgtccaataaattaattgtcctccgtctttatcataacctgaccagctgccacgccattcaccaccgatgatttggttagagtccattttaatattaactccgtacccatctcgcatgtgagaagcataaccagaacgccacatataataattaccattttttccattaactgtattttttccttggatgttatcaaggattgcttgatattcatcagctcgatcaggatctgattcaatcattctcttaagtggatcgatatactctgctgcatagttatcatagccaacatcataatcatatggccgatatccaaggtaaagctccataatatctcctctgattgtccagcttgtcccatcaatcatataatcagccattaaatcaatgacatcttgttcaaatgcataactagtttctcttagcatataaatccaaaaactcatatctctaaacattgacattccatatccattagaatagaactgcctaccatgcatatagaaactgttatcaacctgaactgcttcagcagtattatcatcagtttgaacaactaagcaataacttaaataatcatctacaagttcttttaaatctaatttcttaaatcctgtagaattggtatgtttagtcccattttctgtaataattgcgtaataaacataattttgatcaaaccataaattattttgacctgtaccatatttaactggtgttttttccaataatttattaagcataatatccattgcatctttacttacaatgctttccataaataaagcaattctagaaaatcttaattgaactccaatttgattctcccaccagttagaagaagatggattcatttttccccaataaacaattgctttatttagcttattaattacttcttcgtcatgataaagagcgtttccctctttatgataagcaactgtaattgcttgtagacgatcaagagctaaataaggtgaccatgctgttccattagcagcacttgatgtcgctttgtagtcaacatccccaaaagcaccatcttcttgaatcaaatcaagataatcttttgcttttgaaacatagcatgtttctacttttgacccatcatcaatcgtgtctaaagttaaaaagtaatcttttaaacgcgttttgattgttgcaaaatcactctcacttgcataagttacattcatggaacttaaaacaagcccaaaagacataactaatgacaggattattctcaatgcctttttaatcatataatatcctccttttaaataatattgaaaacgcttactacatctattatttttagttattatcacttgaatttcaacgaaaaatcacttgaaaaagttttttataaacctttataatcagtagaatatggttgaattataaatgatgaaaacgtctttaaatttttaaagacgttcgttcaactattttcacacttaataattgtgtcatcggaatattatctttacgatgaatccgatcaattagattagataccgccacctcgcccatcagttccttttgaacttgaactgttgtgatctgcggtactgatttaacacacaacggtgtatcgtcaaatccaacgacactaatatccttggggacttttaagcccatatcttttaacgcagtaatcacagcaaatgcattagaatcatttgcacatactaagacctctggtaattttttagtattcaaaatttcaattattttatcaatttgattagttaaaacatattcttcaattccttgtagaaaagaatatttttgaatatattcatcaacctttgaataactaacaatattattctttaacagtgactgtttaaatccaataaaacgatcctcaaaactaaaggaataatcaagatctccaaaaaaaccaatccgttgataccctttattaataacatgcgtagtcatcatataactaccttgtttattatgcgtcaaaacacaatcacacggtgtacataatgatgtaaaatctactagaacaacgggtacaccaatatttttaagcagcagcaggttactatcagatattttgcctacaactaatattccagccactttcctttcttcaatacattcaggtactacgaagtgcccttcttcaaaataatttaaaattgaaaaataaccaaatacttttgcttgttcaacgattgaccgtaaaacaatcgaataaaagtgtcctgtatctgcataataactttgcattaaaatacaaatatttgatttagaataaactgatagatattgtcttttttgattaatgtaacccattttatcagccatttttaaaatttctaaacgcatttcatcgctgacaccaggtttatcatttagtgcaattgaaacggcattaattgaaattcctaatttattagcaatatctttcatcgtcactttcatctttgtttcacctcattaaatagtatagcacatgctcctcgattatagtacttctccatttgatgcaattacttgttgataccaggcaaatgatttttttctaattctacgcatatcttttaaatcatcattttcacgattgacgtaaataaaaccatatcttttcttcatttgtgcccggctgcttaaaatgtcaaccggtccccatgacaagtaaccacggcaatcaacgccttcttgaatcgctaatttcatttcctcaagatgtttcctcatataatcaatacgataatcatcgataatttggccatctgcatttatttgatcattataaccaaaaccattttccactatatatattggcatttcataacgatcatacaattgtcttaaagtaattctaagaccagttggatcaatcgtccagccaaattctgacatttccaaataaggattctttttaattacaacatcattaatatttgttagactctcctcaccataatgtgaaattgtcgacatataataactaatagatagtgaatccgtaatccctttctttaatatttctaaatcaccatctaagatttcaggcattgttccttcatttttcatatttgcaaaataatatgaattataatgtcctcttgcaaaaacatctaaaaaaacataagcttcactttgagccttcatactttcaagtgtatcaagaggatgacaagtttctggataactttgaaccactgtcgccattcccataaccttaccacctttttgatgaatatattcattaataagactatgagcaatcaaagtattatgcataatttgattatcaaacgtttgagtatcaactccatccggacaaactgccccaaaaaacatttttggccctttctgtaaaattccattttgttcattaaaaataatccaattttcaactttatcatgataacgatcaacaatctttttgcacagttctacaaatatatcgactactttgcgactataaaatccattatacttctcatataaaaatgctggcatttcaaaatgatataaagttggaattggttgaattcctcttttaagcagtgcatcaataaaatgttcataaaacacaaatcctttttcattatatactccttcatcgctcattaaacgtgaccaatcaagtgaaaaacgataagcattaaatcccatttcctgaaataaatcaaaatcctcttcataacgatggtaactatcgattccgtctttaaaatcagaatattcaccggtaactgttaaatcacaaaccgctggtactttaccatccagtgtatatccaccttcactttgatgagctgtaactgccccaccccataaaaaatcttttcgtaacattacttcttcctcccattctatttctagcagtatagctattttttatataacaaattactattactgatatagatttattatctttaatgtcagcttgaatttcaactcataatcacttgaaaaaaaattaattaacttgaataaaaaagaataatcataatgattattccataattaatcaatagttagtttatctaatttatgtttatcaactattgttatttttcctcgtgatatttttacaataccctcttgactaaaatattttaacatcctagttacaacttcacgagccgtcgccatatatttagcgatttgttcatgagtaatttttaactctaaagaattattcttttcagcttcttccttaagaaaaatagctaagcgtttatcaacagacataaataaaatttgctgcatcgcccacataacatcagaaaaacgattggttgccattttatacccaaatgtttcaacataaatattttgcttcgccaattgttgaaataaagttgccgtgattgtaatgatttcactattttcttcaatatcaataaaaacatcaaatgtaatcgtttctaaaacacatgatgccgaaagaatacatacatcacctgcaaataaacgatatagtgtaatatcacgtccatctggtgataacatatatgtccgcaattgaccctttctcactaaaaccacacctaaacaatcatcactaccacgatgcattgttatgcctttagcataagtttgaagagtggcattttgttttaataactctttttcgttttcatttaaatgatcccaaaaagttaagaattttgttaattcttgctccatcattttcaccctttcaaattaattcaaattttttaatgctttaaaaatgccatcatcattaatcgtgtcagtaacaaaatcactagctgccttaactaaatcattagcattccccatagcaacaccaactccaacatgttttaacatatcaatatcattattcccatcgccaaatgccattacttcacctaaattaatttgatagtgctttatcatttgatcaattcccttattttctccgccatcaatagggatgatatccgcaaagagcgatgtccagcgtgctgatttacaattaggcatatatgataatcgttcactatctttagtctcgtctatatatgccattaattgaattatcttactttcaattatttcattaacagctttaatgggatagccctctttattcagtgatctagcagcttcatcaagacaataattttggatattactataattaccatttatttctacaaataatacgggaatctgatttttgttaatatatggtaataaatttctaatatcttctctttcaatatatttttcatgaataaccacttcatgattaaaacaatactgtccattacttgtgagaaaaccatcaaactcgaaacaatcttgaatcactttaagattattaggtggccgcccagtagcaacgaataatctaattccattcttccgtaatttttttaatgcttcaaaagtactagatggcattaagtgtgtatcatgatccaatagtgttccatcaatatcaaaaaattgcttttatcatctacttatcctcatattattttatcttttagttcttaacataataaaataatcgtctttttattataatgttttccaatacagtatagcatatgtaatccttcaattcataaaaagagaaagtaatagttactttatcttaactactatttgactaaatcaacaatcaactcagtacatttatcgattccaatttcaccactatttaaacataaatgataattttgcgctaacccccaaacttgatcagtataatatttataatttgctcgtctttttttgtctttatcagctaaacgtttctcaggcttctcatctgtttccccatataatctgacgatccgttccacttttttatcaagatcactacaaataaagacattaaaacaatcatctcgatctcttaaaatataatctgcacatctcccaacgattacacatggtccttcttgcactaattctaaaataatctttctttgcatcatccaaatataatcattcattgacatcccatcaatataatgacctaaaaaagcataagcaaaaggattactagatggtgcatattcaccatgttcttcaatataattcacatttaatccactctctcgagctactttttcaattaattccttatcataaaaaggtatgtttaatcgttttgctacctctttaccaattgttctaccgccactaccaaattcacggctaattgtaataatgttcttgcgcatgatctgcacctcctcctaatcttagtcattatctatactttaattttactactttacaagcgaaaagtaatgagaaatcactaattttattgtccaaaagatattttttataccattcatacaataaactataccattcatacaataattaaaatatactaaaagtaagcccctataataaaggtgtaaaagataactgcaagtaataaaggagatttctaaatgaaaaaaattggattaatggttgttgataatagtgtgatcaaacaattaaaggaactaatcattaaaaatattgacagtgaatatcgtatcattgagattcatgataaggaaatgttatttacaaaaaaaatggatttctgtattattgaagattcttttgataatcaaggaatcaattatgctaaaacattaattgaaaataataatgatatgcttgtactaattatctcaaaagacggttcaactattttcgatgcagtaggtattaatatttccagctatctgcgctatcaagatattaaagcgaaatttgttccagcaattcaagatatcatcgattatcttgataaacgaaaattactactatttaaaagtgatcagggcatcgtcaatacccaaacaaatgatattgtttattttgaatatttaaatcgcatgacatatctaaacacattagacaaaacatatcgcatttttattcaaaactttgaatatctacaaaaaatgcttccaaaaaccttttttaaaatctcacgttcagcaattatcaatatctttagattaattactttaaacagtgaaaatgtaattatgaaaaactacgaaaataaagatattgctatttcaagaagaagatatcaagatttacttgtagtgttaaaaaaacatgctatttcttttacagaaaggaaactaaaaaaatgaaaacactatctacaaaagcatctaaacaaaaaatcttatctttattattattagctggtttatggagtatcatgctgatcattgtcttactcgcagctaaaagtacttgggccaaaaatttaaatagtccttattgggctccagccatcattacaattggaataattttctttatcacttacttcatcttcactgtaagagcgttattttaccgccagcacggatatgataatcaatatatatattattataaatcaacaagttattttaatatccttaaattaattattaatacgctttttaataaagaaatgtatcaagataaaattgcctttaaggatattaaaaaatgtgaaattggatggtataatcaaacatttagaatacactcatttggaagtgaagtcgctcatccaatttattttaagattaatgaacagatggttattaaaacagatttaacttcaaataatgagcatattattgagttagctaatcttcttaaaagtcatgtaaaaaactttaaagatccctaccatttagttttagcaatgaacgatcgcagtattactgtatacgaatatattgaacgcatcattcataacaaaataatcaaaccaaatctatataaatagacgtgcgaatatttcacacgtctattctttattattcaaaatttaaataatatatcataaaactatcctgctcacagttttcccaagactacttatacaaaattgataaattttataattaaatagcaccttttcaaacaccctattactatattcaaattttgatttgaacttttcataacaattctttccaatcaattttcaaacttatctaaacatatattattactatttcttataaatttccagtattctacaaaagcttttgtttcacacgtaattactctattttctcctcaatataagcccacaaacaatcctcattatcattttctatcgtatagttcaacaaccatatccaataatttaatcttttttatacgttccttcttagtttcccatttttctaacaatgtgggggcaaataatcttttaatgtttcatgatcttgatttgaccatgacatttaaatcgcataataacggttttctacttttttttattcgttcctcattccaaaaattatcactgctatctaaaactaacaattgttttttataagtcgatatatttttagagctttcatttgatgttgaagtgccacactaataaatgtaacaatgaaaatatcagcaaaaatcagtacactaatcatgcataataattcttaatcatcatcccctcttaaatgttaaattattcaaatggataaatcattccccattgagtccgaatttgacttagcagtgaacttacatcccgagttaactgtaattcatattcaccaagattatttataatataatcttgcatatcaataacttcgtattgtagtccctgtttatcatcaccacattcaatgacttcctgatgaccatctttagtataagttatcgttgcttgattactccgcggataattattaatttctatataccccaattctcctgatatgaccccacgcttcggttgttttgcacgcattgttagagccattacaaccatttgaccatcttgatttttcataatgattcctgattgttcatcaaccccagtttcaaaataatcagcagttgtaattacaacattaggttttgatgataaaaagtaccgggcaaaacttgttgcataaacaccaatatctaataatgccccaccagctaattcttttgaaaagaaacgattattaacatcatattctttacagctgccaaaattgacttgaatcatttttacatttccaattactcctgcagcaaccatttcctttaattttttgtatagcggcatatggaaaattgtcatagcctcttgtacaacaacattatttttcttagctaaagcaactatttcttccaattgacgatcatttacagtaattgctttttcacataaaacatgctttttcactgctacagcctgtttcatgatttcataatgactattatggggtgttgcaatataaacaacatcaacatcaggatcatttaataattcctcaacacttccataagcatttttaattttatatttcattgcaaaatcaattgctttattcatatcacgatgtccaaccgcatatatctccccatttacatccaacaaagcctgagccatttcattagcaattacaccactgccaataattccccaatttaattttttcattattatttcctccgtctaatcttcatagatatattatacatagattacaaatagaaaaactagcaagaaaataattttctcaccagtttcataaaagcctatctttctgacattttaaaatctcttaaagcttaataaaaaactcaaaaatttaaataaagtattcattttccctaggtgttgccagtttcttgctaaaactttctgcaaatgtttgatattcttgattgttattcatactcttagcatggactgggcaaatacgaatacatctaaaacaagcaatacaatcattattaattgtcttacaatcttctatatcaatagcatttgtaggacacatattgacgcaaaccccacagccgctgcactgttcattagtttctgggcgaaattttcccccagttcctccttctttatatgggtatttccctggtactgaaacaaatgaaaaattatcatctttaatttttagccgcaccaaactaccaaacaattcatcacgatataagtcatcacgattaggacgacccacttgaatttgaccataagtatgttcacccactaaagctgcaccagcaataggaataaatccttgctccttaacagtattaaataattctaataatgcatcatcataatgacggtttccatatgtaacagtaattacacatgatgtatgatcaccccgaaatgattttaaccgttccaaagcctcgtgaagaattcttccaccgtaaaccggaaaaccaaaaactacaatatcatgacgactaaatgtcatctctggaatcgtttcttctagtgttaaatcaatttcacttaactctccctcaagtccacgagcaatactaacagctgacttcttggaagtgtaagttggtgaaaaataaattgcatatgtccgatcaatcttcataatatatcctcccacctttatttattcttttattatatcattaaaatatgtactatctattaattaaaaatagattatcacaataaattgtattatgattaaactagaggtgatgaaatgagtacctattttataaatcgtataactattgatcatgatttaatcgagcgaaacagttatctaaatacaattgctacaattaaatactttgatttttgataatccgattaccttttttgttggagaaaacggcacaggaaaatccactttattagaagcaatcgctattaaatatggctttaaccctgaggggggaactttgaactttaattttcacactaacaatactcattcatctttgcatcatgcaataatccttgatcgtggttatcgtcgtcctgatgaaggcttctttttaagggcagaaagtttttataatgtcgcaacacaattagaatgatatgaaaaaaatgtttttaatccctatcgctattatggtggtaaatcattacaccagcaatcacatagtgaaagttttttaacattgattcaaaatcgttttaatcagaatagtctatatattcttgacgaacctgaagcctcattatcaccccagcgccagctaactttattaattactatttatgaattagcaaagcagggctcacagtttattattgctagtcattcaccgatcctattaggaatccctgaggcaaaaatacttaattttgactcaaaagagataacacctattgattatcaagatactgagagttatcaaataacagaactctttattaataatcgtgccggtctattaaataaattattaaataaataagatcatctaccctttcaatatgattttatttttataaaaaaactagctgcataagcagctagttaagccatttctgttaaatcatcttttatttcatcaaaagcaacggcaatgtttaaaccatgatcaccaattctttcaaaatcaattaatgtttctgtatataatgcactatgttccggcgtacattttttatctcgcaaacgtcttaactgattaagtgaaaattcatgtgttgtaatatcaatactatcttcaataacatcaactttttcaacaatgttatgaagttcatcgcgatttaagacatttaattcctctaagatatttcttgtcaggtcattcataattttaatttctctcatcgcttcatctgaaaaatgttcatcttcactatataatttctcagcacgttcagcaatattaaccgcatgatctccaactcgttctaaatctccagccgtttttaagaataagccaattgatttagaatcatcgattggaaattcattagaaatagcattggttgtaaactgaataatttctttgtttaaataatcaatatattgttcatcttttaataatttttcatgtgtcttttcatcatacttaataattaaatcaaaagctctttgaacatttttttgaactatatttaacatattttgtgtttcattaaataattgtgtgttagcgattgcactagttccaatgtgataatcattggtaaagatactattatccaagaacttaacagataatttatcttcaaaaccttctttttcaggtaaaaccaaatatgacaatttaactaactgcgccccgaatggcagcaataataatgttgtaacaacattgaataccgtatgtacattagcaatttgtgccggaatatttgttggcgtcaatgactgcataaatgatgcaaacggtgttaacatactaataaaaacaaagacgatcgttccaataatattaaatgaaagatgaatgatcgttgtacgttttgcattacgccctgttccaatactagctaaaacggcagtaatacatgtaccaatattttgaccaaataatacatatattgctgatggtaaagtaattacgccactcatcgctaaagcttgcaaaatcccaaccgaagctgaagaactttgaattatcgctgtgaatccagcaccaactaaaataccgattaatggattttcaaacgtagtgacaagattaacaaattccggtgaacttctaagcggtaccatcgcactagacatcatttccattcccatgaagagaattccgagtcccgcaataataccaccaattgcatcaagttttttacttttgaaaaaagcaattaaagcaacaccgacaaatgcaataactggtgctaaagctgtaatatcaattgcgatcaattgacctgtaattgtagtaccgatattagcacccataattacccaaaccgcattttccaatttcatcaacccagcattaacaaacccaacagtcatgactgtagttgcagatgatgattggattactgcagtaataactgctcctactccaacgcctagaaagcgattcgtcgtaagtttttctaaaattgttttcattttgtttccagctgctaattcgagaccatttgacatcatcgtcatcccgtataaaaatagcgctaaaccaccaaacatagcaaagaaatctgtaagttccatcttattccccctgttacacggttactttaacataaaatttacatactgcaaagattgttaacaaattcttaacttttctttacatatttttacgcattttattaagtttattcaattttcttgacaatcctccaatttaagatactattactatagacagttcatttgtaccatcctgtctataaacaaaactagggctatgctttttatgttgtttttaagcaggctttttagtgagcctgcttttttatttgatggtatagaaggaggaaagatgtattttttaaaaacggaacaaagttttgatagtgcacattttttagctggttatcatggtaaatgtgctaatattcatggtcatcgctggaaagtcattgcaactatcaaaagtgaaaaactgctagaagatccccaaaataaaggaatggtaactgattttggagatttaaaaaaagatttaaaaattatcgcagatagttttgatcatgctttaattattgaaacaggcagtttatcagaaaaactataccaagcactgatcgatgaaaatttcaaaataatcaacttaccatttcgtccaactgctgaaaatttagctaagtatatttacgaggctttaagtaaaaattatttagttgattgtcttgatgtatatgaaaccccaaataactgtgcaagttatcgaggtaaattatgaataattataaggttgttgaaaaatttattagtattaacggtgaaggaagtcgtgcaggtcaattagccgcctttattcgttttcattattgcaatttaaattgtagttattgtgatactaggtatgctaatgattcaaatagcaattatgaacttttaagtgctcaaaatatcctagattatttaaaagcaaataaagtcgttaatgtcactttaactggtggtgaaccattacttcaacaaaatattgattatttaattgatttactgcttaaaaatggttttagtgttgaaattgagactaatggtagtattgatattaaaccctttattaaagaaactcgaccaatctttactttagattataaagtacctagcagtacaatggaaaatgaaatgtgcttaaataactatcaatatttgactaaaaatgatgttgttaaatttgtagttagcaatctcagtgatttaaataaagcaaaagaaataattgatacttatgaccttgtcaatcgtaccaaagtttattttagcccagtctttggtaagattgaaccacggatgatcgtcgattatatggtcaaacatcatctaaatggtattaatatgcaactacaaatgcacaaattcatttgggatgttaatcaaagaggtgtctaaaatgattgatactaaaaaaatagaggaacacatctacggtattcttaaagccttaggtgatgatccagaacgcgaaggattaaaagatacgcctaaacgagtggcgaagatgtatggcgaagtttttgctggaatgaactatagtaatctagaaattgcaacgatgtttgataaaacatttattgacgatttagacttcgataatcaagaggttgttgtaatcaaggatattgatatctttagttattgcgagcatcacctcgctttaatgtatgacatgaaagttacggttgcttatattccttgtggtaaagtaattggtcttagtaaaattgcacggattgctgatatggcagcgagacgtctacaacttcaagaacgaatcggaacagatattgctgaaattattagtctagtaacaaactctaaagatatcgctgtaatcattgaaggtaaacatagctgtatgtcatctcgtggaatcaaaaaagttaatagcactactgtcacaagtactctaaccggtcgttttaaaactgatagtaagctgcaaatttatttacattaaggagtagtaagatgaaagtattagtattatttagtggtggagttgattccaccactgcattagcactggcaatccaagaacacggaaaggacaatgtagttgctctttcaattagttatggtcaaaaacataccaaagagatagaagtcgcaaataaaattgcccaattttatcaagttgaacacttgtatttagatttagcaaaaatcttcacttatagtaattgctcattactacaacattcagataatgagattccccacgaatcgtacaatgagcaattaaataaaacagatggcaatcctgtttctacttatgtgccttttagaaatggtttatttttatctagcgctgctagcattgccctttctaaaggctgtaatattatttattatggtgctcatagtgatgatgcagctggaagcgcatatcctgattgtagtaaagtttttaataatgcgatgaaccaagctatttatgaaggcagtggccatcaattggaaatcaaagccccttttgttgaaatgaccaaagcagatattgttaaaatcggtctttcattaggcgtaccttatcaattaacttggtcatgttacgaaggaaatgataccccttgcggcacatgtggtacttgtattgaccgccaaaatgcttttttgaaaaatggaatcaaagatccattattaggagaataaaaatgacaaaaaatttaaccttattaggtaatcaaaacactgtttataaagatgattatgcccctgaagtattagaaacttttgataacaaacatcctgaaaatgattattttgtaaaatttaattgccctgaatttactagtctatgccccattacaggacaacctgattttgctactatctatattagttatgttcctaatcaaaagatggtagagagtaaatcattaaaactgtatttattcagttttaggaatcatggtgattttcacgaggattgtatgaatatcattatgaaagacctgattaaattaatggatcctaaatacattgaagtttggggaaaatttacaccacgtggaggtatttcaattgatccatattgtaattatggaaaaccagaaacaaagtgggaaaccattgctttcaaccgtttagctaatcatgatttatatcctgagaaaattgataatcgttaaatataattattagagacctttttcaaggtctctaatttgttttcaactttacatcaaagagttagctcaaaaaaataatatattttaaaaccgttgacatcatattaatcatcatttatacttacattaaatacttttataaaactattttatataagatgtctggaggaagaaaaatgaaaagtgcagtattttacggaaaacatgatattaaggttgaagaagtagaaatgccacaattaggtaatcaagatgtattaatcaaagttatggcctgtggaatttgtggtactgatgtccatatttatgagggtgataaaggagcagcaaatactactcctcctactattttaggacatgaatttgctggaatcgtcgaagctgtgggacatgaagtaaaacatgtaaaagttggtgatcgtgtctgtgtggatcctaatcaactatgcggaacttgttactattgtcgtagtggtattggtcatttttgtgaagatatgattggcatcggaacaacacgggatggtggttttgcccaatattgtgcagtcaacgagtctcaagtatataaactagccgatacaacatcatttgaagaaggggcaatgaccgagccagttgcctgctgcttacatggtcttgacatgtgcaacattactccggctagtacagttcttgttattggtggtggcatgattggtttgttaatggttcaattagcaaaattagctggtgctcatgaaattatcttgtcagagccagttgctgttaaacgtgaaatggggcttaagatgggtgctactttaaccgtcgatccaatcaatgacaatattccagctcttttagctgataaaggaattcatcgtatcaacactgttatcgagtgtgctggtctacctgcaacaattaaacaagcaatcagcttagctggtaataaatctgtagtaatgatgtttgggctaactaaacctgatgatgaagtggctatcaaaccatttgaaattttccaaaaggaaattgaaattaaagcttctttcatcaacccatatactcaacaacgagctttagacttaatcaatagtaaaaaaatcgatgttagttcaatggtttgtgatatttgcagtttagataaattagccgatattctttcaaaaccagaattaagaaataaaggtaaatatattattaacccatggcaataagaatgtacaattttatgtacattctttttttgccatatatgaaaaaaaatggacattcgccattttgtcggttaagatttaactgtaaggagaacgaatatgaaagatattgaaaatgtatgtttagaagttgatgagttagatttcgacaactatagtccaattagtccagatattgttttaacatcatcatttaaatttaaaaattttgaccactatgtgaaagtgaatgctaaagaagaatttgcttatacatacacacgggacgggaatccaacacttaatttactagaaacaaaattagcacgtttagaaaaaggtgaagcagctcaaatgttcgcctcaggaatgggcgctatttcagcatcaattttaaccttagcaaaagctggtgatcacattatcattgttaatacagtctatggctcatcagttaaattaatcaaacaattatcaaaatttggaatcgaaagtactaaaattgatgtcagtgatactttagaaatctttgattatgtcaaaaacaataccagtatcatctattttgaaagtccatcatcacaaaaatttgagatgttagatttagaactaatcagtaaatttagcaaagataaaggtatcttcacgataatcgataatacttggtcaacaccattattacaaaatccattagttcatggaattgatgttgttattcactcatgttccaaatatattggtggacatagtgatatagtcggtggagtcgtaatttccagcaaaaaaattattgatgaaatagttgaatttggacaagttttactaggcgcaacgatgtcaccaatgaatgcatggttagcacttcgtggtctaagaacattaccggttcgtctaaaatcacaacaagaaacacttcaacaagtaattaattttctacaagaggatcctcgaatcgaacgaatttatcatcctctttgtaacggagagcaacaaaacgaacttgctcataaatatcttaaaggatatggtagtttattaggggttgtcttaaaagatgcaaatccagaaatcattaaacgttttatcgattcattagaacattttactttagcctatagttggggtggttttgaaagtttagtaatgtcagtttataaaggaaacaatattaatgagataaaagaacgtggtctatctttaggacaacttcgcatgtatatcggacttgaagatagtgaattattgattagtgatttaaaaaatgccttggatcaagcatatcagtaataaaaataagggttgagcaatattactcaaccctttctttaaataaattgaccttgaggcaaatccagataaattctcgcatttaaaattttttgtccattaacttgagctttatttgaaaaaagacgtattagtacaataactgcaagtttattactagatagagcattattatcacgattagcaattaaaacaacattatttgccacctgccatttgccattacaagcataaaaatcttcaagctctcgtttacacgtaaaaattccaaaatctaaattatcctcaatccatttagtcgctgtttgaactatttttgaacttaatccctgcctacgataatttggcaaggtagcaatacaactcaatccaccaatttgatatttttcattatctatcgttgtttccatccgaagaactgctccgtaactaacaacctgattatctttcatgatatagaatgactgcactgtaagttcttcgttatgggcatcattacaatcatcactaggccaaacaacatgtaaaagatgtacaatttctctttttatttctttggacatttgataatagtccaaagaataaacagtaatttcttccattatccaagtaattcttgcaatgcattaatgtccgcaactaaataatcactattacaagccatcaattcttcttttgtcccataaccatacaacactccgatacaaggtaaatcattttcatgggctccaatcacatcatgctttcgatccccaaccataatcgcttcatctttatcaatcatatttgctgttaaaacataatcaattacttcagcctttttttctcgtccattaaactcactaccgccaacaaaatcaaaatacttagctaaaccaaaatgttctataatttctttagcaaatttttctggctttgaagtagcaactaacaatacttttccctgatctttcaaagtttgcaaacacacttcaattcccggatatactttattatcaaaaattcccttggttgaaaaatattcgcgatatttaactactgcctcttcggcttttaaagcatcaaaaccataaaattcttgaaaagaatctcttaaaggtggtccaataaaaggtaacaaatcatttaagtcattaacttcgattccataataatttaaagcataacgtactgatttagtaatccccttcatcggatcagttaaggttccatctaaatcaaacaaaatatattttttattcatataagtcctccactacactaacttatattttatccattattccctacattagcaactatatatgcccttttatctgtagtaattaataaatgtttttgatcaatgatcattacttcttttaattgctcatctaattctttttgtggatccaaatcaactaactgattactttcaatatcataaagataaagtttttcattattaaataaaacaagataatctatgctacaataagttcccatataattagtaccataaaaatgataatcaattcttgaaacagcgcctgtaataatatttgttaacttaatcgtttcatcactatattcaatattgacaatcgttccttccaaaggatatttatctaacgttctaacttcatttgttaaaatattaattaaataagaatgtccattttcatcataagtaacaacagtctgttcatcaataaaagtaatacaattactatgcatatatggatcgatatttttaatgagattggtttctccagtttcaatattataattttcccacccctgatcactcttattaattaaaatattagtttgttgtggtgaagtaattggatttactgaaatattatcattagtaataaaacttatttgcttactttctaaattaatcttagcaatatttaaagcacgctgctctccatcattaatatcgacacaaacataaatatcattattaataattttaggcaaaacactatatatacatccattaaaatcaaatgcaactattcgctcttgataatccgcatatttaaaactgaattcatgaccagctatactcccgtaatactcattaataggacattctcttatttgttcattttctaacgtaaaaactttaagaaaattataatcctcatcaatgattccaaaaaattcattttcagcacgccaatgcccataatctagttttaatgtgggagtatttttgttgattgaagaaaattcaagagctgaactaattttcaaattactgctaaatcgctgactcaaccaagtacgaaatgaatcagaaaatgcataagtaattcccaatgaagaaattcctattgtcataacaattaaaacaattgcaaatatatacttaattctaatcaccttcgctctttttgtcggttcaaaattagttgcagtcacttcatcgatccagtttctaggagtttttattaagtcaaattcattaaatttattcataaaaatcatctcccaactttttctttaacaattttcttcccctaattaatcgtgattttatcgtattgtgattttcttttaaaatagatgcaatttcattagttgaatatccttcataataatacaagtataaaacattacgatatttacttggcatattcattacaattggtagaataattaaacgctgatcttcttgacctaaaatcaacttatcaatatcaatttcccttttccaaaattgtttttgataatctttacattcattgatagttaccctaatcaaccaagcttttaaatgttcctcactttcaaatttcttgttgtaacagtataatttcataaatacattttgatagcaatccttagcatcatcataatttttaacattcataacagcaattctagtaaccatgtcactatactgatatacaacttcttcatatctttctttttccataacgatcccttccactatgaatacgattaaaaatgttcaacgggtgcattaataattattttttatactttcattataatcgattgttttacttttttatcgatttagtaaaataaaacagcccaaaaggctgttattgaagaaaatcgtctttacgctgaactaatcttctaacaaattctgttttaggatgttctaaaatttctcttggtgatgctaattgtacgactttaccttgatccattaccataacccgactacctaatttcaaagcttcattaatatcatgtgttacaaaaataatcgtgatattttcttgatgatgaattcttaaaatctcatcttgtaaagtagaccgtgtgatttcatcaacagcaccaaatggttcatccattaaaagaatatctggggaagcagctagtgctctagcaatccctactcgttgctgctgcccaccacttaattcactaggatatcgatgaattaactcttcatctaaccctactattttcatccattttgatagtgcttcataagttctttttttatcatttttatttaataagttaggcacataagcaatattttgagctactgtcatgtgcggaaataagacacttccttgaattgcataaccaattcctcttcttaattcaattaaatcaactgcctgtgtacattgatcatgtacaagaacttgtccttcatcaggaattattaaaccattgatcatttttagaatagtggtttttccacaccctgaactaccaactacagttaaaaactcaccaggtgtaatttttagattaaaatcatcaataattactttttcaccataaaccttttttacatgtttaaattcaatagctgtatccatatgttcctcctatttcactaaattaatgctaactaaaaattcgtgagccacatcttcagcatcttgtccttttgtttcaaccaaatagttcaattgtgccatttttgtttcattgagaataccagtaagtttatcaaaaacattatttaattctggatattgttcaagaatttcattgcgcacaactaaggcccccatcgaagttgaaaagaattgttgatcatcttcaaggacaacaacatttgctgttgatagttgaccatcggttgtaaagacatccatgacatcaaccttaccttcatttattgcctgatattttaaaccaatgtctaaatccatagtattcttaaaagtaaaattatatttttggcatagtgcatcataaccctcaggaatttcataaaaatcatattcagctccaaaaactaattgattagatattcctgctaaatctgaataagtttttaaattatactgctcagcaatctcttttcttactgctaaaccatatgcatcactaaaccctaacagccctgtccaggtaaattgatatttttcttgatattctttaactagctgttcatacattgtttcattataaaaaccttcatgttttaaaactgtattccaacccgtactcgtatactcaggatataaatcaaactcaccgctaaccattcctggttgaatatttgaagttcctcctcctactccctgagtaatcttaacttcaatatccgtatcttgttcaatcatttctttcaacattgctccaataatatattgctccgtcataggcttagtagcaatatttaaagttactgtttgattaagattgcctgaaatcattgatatgatcaagactgcacaagttgtcacaattactactaagccatactttcttttagattttaaagtagcttttcgaatggtaaataacttttcaataaagcctaatactatatctgtaattaatgcaagtattgcaatcaataaactacctgtcaaagtcattgccgtgttattggtagtaattcctcgatatatcgctacccctaaaccaccggcaccaataaaagaagcaatccctgctaatgctattgtcatagttaccatatttctaaaaccagacataattactggaagtgccaacggtaacttgattttgtataaaatttgccaacgtgttgatcccatccccgttgcagcttcaataatattatcatcaatattaataattccagtatatgtatttctcaccattggtaataatgcataaacacttaatgcaatgattgcggtactattaccaattccagaaaaaggaattaaaaaacctaatagtgaaatagagggaatcgtatacataaaattaataattcctaaaattgttttagaactttttttatattcactgattattactcctaaaatcaagcctataacagtcgcaataataattgcaattagcgatatctgcatatgttcaattaataattttaaaaagaaatcccctttttcttgtaataaagatagcatatctcttaacataatctaacctgctttctcaattgcccgcaccggacagttttcataacataaaccacaatgtaaacaatgatcttgcattattttatacttgcttccacttttaatacattgttgtgggcattcacgcttacagcgatcacaagcaatacacctattactaatcagatatcctttattaaaaattcgattatcacaaagatcatattgtgaacgttcaattggtacttttgataaatcaaatatttcaatttcaccatcaaaaatacaaaatacttctaaaatattacgactatcacctggataaacctcattcatactcggattatcaataaatattttttctaaccattctttttgattactgacttttttaacttttccttttaaacgaatcgatgcataatcttttgttagcgcaactaatgaaacgaaatttttatcaagtaattcttgataaaagtttttcccccgagcagtcaaaaaatacaaattattattttccacagccattacatcgatgattctaatttgtggatagccgtcactgtctacagttgccattgctacatcttttatttttctaagttcatttaaataatcattaactttcatcactcttacctccgctcgtctttaatatacactagttgatttttatatgaaagaaggcacttttttgtaacctagttactttaacgaaactaaaaaactatagctagtcgtgtacaacttcatagctatagctctaataataatcaaacttatactctataatattgtattaggcacaccataagtatactgttctaatatcaaaataacaaatcatatgcctaaaataaactactttgcaaaaaacctgaagtaatcgtcaaagactgtggtactgtccttaaaagtgcttcaatatgacgattttctaaccagtcatgatttaaatgctcctctaaaatcaatggcattcgatcatgaatctcacacatacttttatttgcttttgttgtaacaatagtcacttctgtttgcccgttaacatttcgataaattcctgtcattaacaataacgatcgtttttcgttttcaaaagtgaacttatgtttatgaccgtcccattcatagaagccactagctggaataaggcaacgatgagtaatcacttcttttttaaagaatggtttttccaataaagtttcacttcgcgcattaataattaatttattatcaaaagtactaaagccccattttgccttttttaattctaatttattatctcgatcaataatgattggtacaatattacttggataataatctttagcaattaataaatcacgttcaaatgtatagtcaattctttcttccaattccatcaaggcttttaattctaaaaaatatctgccacacataataatctcctattttaccaattcacattttaaaaactctaagatttgcgcatttaatgaatcatcattttttatctcacttaacatggcaacttcattacaacattcaccacatatatcaatcccaataacatcgccacgtttaattaaatctgctaaaattaatttaaattcaattaaccgcatctgcccctgctgccaatcagtcgtgactacttgttcacttaaaacatctttatcaattgaaaaataaacaggatattgtttcaaaagttcatcaattatcttccaaacttttaaatcaccaagattattatcacacaaataaataacgcgctccctatacttaggatcgattaaatcaacttgttcttgtgcaattccaatcaaaatgatctgttttaaatattgattattttttaaagcatttaagatccatgatccacagcttaaaatatccccaaacatcggtttaatcatatcactatgatgatcaaagactattaaaataaaatcataatttatcttccttatccaaaattcacttacataatgaaaattacctgaatcaataaaatgtattcctgcaggcagataatcacctattcttttaatgatcttcgcttttgcctcctcactgcaataaccacgtgtccccttaatatctaaacaatcaatccaattaatatttttatgcttataaaaactttctaactcataaataccagtaaaatccatgacagttaatttcttttcatttacaatacttaccccataaaaccagctccatttaatgcttataacaaaaacattctaattcatgatcatcaacaatacctattgcttgtaaatatgaataaatagttattgagcctacaaaactcattcctcttttttttaaatccatcgaaatatcatcagataacttcgttgttgttttaaaattattatccttatttttaataatttgatggttactaaaaccccaaagatagtcagaaaaactaccaaattcagtttgaatacttataaaaattttagcattattaattgctgcaccaatttttcgtttacttcttattattttttcatttgctaataactccattacttttttatcatcatagttagctattttaattacatcgaaattatcaaatgccactctaaaagcttctcgtttttttaaaatagttatccatgataatcctgcttgaaatgtttctaataagaacatctcatataatttttcatcatcataaaccggtacaccccattcatgatcatgataatttttataaatttctgacttttcatctacccatgaacacctttttaccatcatcattctctcctttttaactattttatcatgcttataagaataagcaaatattacacaaaaaaactatcccagttaaaatttctcattcatcatatttaactttttaaatattttttccagcagctaaaataataaattatattacttttaatattgtttagtttttagtacaatgtttcaagatgttagaggagatttaaaatgaataacaataataatgatgtaacaaaaaaatatggattatttacagccattacaatgattgttggaatttgtattggctcgggtatattctttaaaagtgataatgttttaattgctacaaacggcagtattgcactaggcgtgctatcatttatcttagccgcaatttcaatcatttttggttgtcttacaatcggtgaattagcatctcgcactgataaagttggagggctaatctcatatgctgaaatgtttttaactcgtaaagttgcatgtgctatgggctggtttcaaacctttgtttactatcctacaattacttctgttgtagcttgggtcattggagtttatataaacatattatttaatttacaagccagtttagaatttgaaattttaattggttatatctttttactactttgttttgtttacaatattcttttaccaaaatttggtgcttttatccaaaatagtacaaccctaataaaactgctccccttatttattttaggaatattgggaattatttttggtgatcctattaatggtttagcaaatactagtatcaatacactaagtggtactgggtggatttctgcccttggtcccattgcctattcatttgatggctggatcgtaacaacttctatatctcatgaactaaaagatgctaagaaaaatatgcctaaagcattaatgctaggcccattaatcgttttaagtatctatgttttatactttattggtatctcatgttatgttacacctgaagtagttatgactttgggagatcgtcatgtcagtttggcagcacaaaatttatttggtccagcctttagtaaaatgattatcatttttatagttatttcggttattggaactgttaatggtttagtcattggctatattcgcatgccatattcattatctttacgtaaaaatatgtttcccttttctaaacatttgcgtaaaatcgataaacgttttcaaatgcccttaaattcagctatctgtagcttgattatttgtacgatttggatgttcgtccattatttatgtactaaatacaacctattatataatagtgatgtatctgagggagctatcggaatatcctatatcttctatactttattatatataagggtatttaaaatgtatcttgataaggaaattaagagtaaatttaaaggtttagtttgcccgattttagcaactatcggctcattgattatcctatctggaggtattcaaaataaactatttattttctatattatattttgtattttactttttctatactcattatattactatcaaaaaaataatcactaaataataaaccatctcttagaatcaagagatggtttattatttataaagttgattcattccataaaaattcttctatatcttcataacttgaaatctctcgatcaaaaacataagcaaaaaattgctgcaaattcggtatatcatattgtttaaaatccacaatatacagcatttcatatacttctttcttcaaaatccgtaaatctgaaataaagtaacaccgcataagttttacagcatcttcaaaaatatctttttgcataattaaccatcctttcaagtcatatatctatttcttctctttatcctaactccgcttgatttgtaatttcccattgaccttattaacttcaaaaataaacggatttttctggaaccagactaaatcagcagcctttaaattccactgttcataagcaataataaaagtttgataaaccagctcttcagcttctcttcgagtctctagagccgattcgaaatttgaatatgttcctaaatcaaaacgtttacctttaaaaccaatactagctcgatatttattatttttcagtttataaataccgcatgctccactagtattatttctttttaatttttgtgagttaataaactctatacatgtaccatcaaccaaatgaagattattataaacactttcagtaatctcttttttctacacccacaaccgacatactgcccgtgcattagcccagtttcactaacttctgtgttcttttttctgttggagaaattgccataagtcgccaaacttctgtccttttttagccttgtttttaggaatacagctacaattagtgattgtccctcgtttcagtttttttgtattaacaaatgttatttctccacactcacatctacattcccatactttatatcgagcttctaatttatttgtttcagccaagacgagtaatttaccgtattttctgccaactagacttttagtctttttcattaattgaatttactttaagcttagaagcagataaacaaatttataattgaacaacataactgtgtcctcatttattcgttcatccctcctcaataattctagtactaataatgtaaaattgtgtttatatttgtcttgcacatagtacaaattcgtccgcataaagtagacttattcattcgaaaagataaagctttatttttaacgaaaaaactataaaaacacacaaatttctttctactatgattaattttgatgtactatctgtcaattttcattatacatttgttgaacgataaagtctactattttcataataatcatcacttcaaatgaacccatcttaaaaatgtatcttgagaaacattaatagtagtggctgcttcccttgaggtgatttttttatttaaccatttttcctttaaatcataaaactcttctggaacaggaatgcacggtctaccaaattttacacctctttttttagcagcctcgattccttcacgctgtctttgcttgatactttgtcgctcggtttcggctacatatgaaagaatttgaagtactagatctgcaataaatgtccctgtaagattttcttttcttgttctagtatctagtagtggcatatctaaaacaacgatatctgcttttatttcttttgtaatgactcgccattgctctaagatttcttcgtagtttctacctagacggtcaatctctttaatcactaaaatatcttgctctttcaatattttaattaattcactgtacttgggtctatcaaaatccttaccgctaaacttatcaatataaatattttccttttttactggaaattgtgataaagcaataatttgccttgcttcattttggtcttttgaagaaactcttgcataaccataaatatttgtcataaactaaaacctcctaaatttatgcagtattataaaaatatctgcataaatattattaacaagttatgataaatctatattactgaatgtaaaaaaagttagtaataagtcgatgttactaactagctagaaatattattactttataaattgattttaatgaataaataatttattaaaatcaaaacaggaaatatcaagataggagaaaattatgactaaatcaaatacaattattgaattaaaaaacaaggtgtagttgcagtaattagaggaacaagttatgaagaaggtcaccaaacagccaccgcttgtattaaaggaaatttaaaagctattgagattgcttatactaacaataatgctgacatgattattaaacaattatcaggtgattatcaaaataataatactgttttaattggtgctggaactgttttagatgcaccaactgcaaaaaacgctattatggctggagctaaatatatagtatcaccagcttttaatcaagaaactgctataatttgtaatcgctatggtattccttatattcctggctgtatgaccattaaagaaatcattactgctatggaatatggctgtgaaattatcaaattatttccaggaagtgcttttggtcctaactatattaacgcaatcaaagggcccttaccgtatgtttccttaatggtaactggtggtgttaacctaaataatgcagctgagtggtttaatgctggtattgatgctattggcattggaggagagttaaacaaactggcagctaaaggtcaatttgaaacaatcaaagaaattgcacaaaaatatgtaaatactaaaactagaaaataattcttatatctcaataatataataaaaaactattatttaatattttgttataaaattagattataagagaactcccaatattactaataattcaaaataaaaatactttttgcggctatctaacactttgtgtaatcaaacttatcaattgcagaaataaaagatttctgcaataaattaaatactaatataaattaaggagtaatttctgaattgaatagaaactactccctttaatttgattgtaattatttaaatagtataatacttgacatagtcttatattcttatctataaaacactttttatgattttaaaaatatttttataaacgaattatttaaataatttttacatattaagatgcacccctttcatttgaatatacatgtccaagattccaagtatatatcaaactttggggtgcacttcattttaataagaactttttaactgcgagatacctataatcataaatattacatttcacaaaaactatattttttattataagttattagagactccttttttagctagtctattgctacacctgcgcttacataacctgcaacagtgttgactaaactcaatccagatgcccgtgcagttaaaacaagcattaatcttgttcccgccggaacattaatatttaagccagttaatattcccttagaaatcgttcctatagaaattacacctgttagtgaaggcgttaatgttacagttgttccaggcactacagtcatagtgttgtttggagcaattgattcatataattttgcttcaatcgtaattgtacttcccactaatgataatgctgctgttgttgaaaagaatacatcgattgaagtgatgactccatctcttggcattgtaaaagcaaagtttgttaacgtgccagatggattggttaaatcaattgtattaccaatgattgatattcctggtgctgagctaccaaaccctataaatgcaggggtacctactaaaccaccagcaatagttgttaaagatacaggtaaaccagatgcaaatggtattattgctgaagctccagctgctcctgttgatccagtcggtccggttgaccctgttgctccggttgctccggttgctcctgttatcccagttggtcctgtcggtcctctatctccgtttgcaccatttgtaccagtcggtccggttgaccctgtcgctcctgttgatccagtcggtccggttggccctgttgctccatcttctcccgttgctccggttggtccggttggtcctgtcgctcccgttgctccagtcggtcctgtcggtcctgttgctccgtcttcccccgttgctccggtcggtccagttggtcctgtcgctcctgttgctccgtcttctcccgttgctccggtcggtccggttggccctgtcgctcctgttgctcctgtcggtcctgttgctcctgttgctccgtcttctcccgttgctccggtcggtccggttggtcctgttgctccgtcttctcccgttgctccagtcagtccggttggccctgtcgctcctgttgctccgtcttctcccgttgctccggtcggtccagttggtcctgtcgctcctgttgctccgtcttctcccgttgctccggtcggtccagttggtcctgtcgctcctgttgctccgtcttctcccgttgctccggtcggtccggttggccctgtcgctcctgttgctccggtcggtcctgtcgctcctgtcgctccgtcttctcccgttgctccggtcggtccggttggtcctgtcgctcctgttgctccgtcttctcccgttgctccggttggtcctgttgatccagtcggtccggttggtcctgttgctccgtcttctcccgttgctccagtcagtccggttggccctgtcgctcctgttactccggttggtcctgttggtcctgttgctccgtcttctcctgttgctccggttgatcctgttggtcctgtcgctcctgttgctccgtcttctcccgttgctccggtcggtccggttggtcctgtcgctcctgttgctccggtcggtcctatcacgcctgttactccggttggtcctgtcgctcctgttgctccagtcggtcctatcacgcctgttactccggttggtcctgtcgctcctgttactccggttggccctgtcgctcctgttgctccggtcggtccggttggacatctaataataattggtggcctgcatcggcaacatggacaccatatacaaccattataattacagtctttcatcttatcacctcctttatgtgatctaatataatatacgcaaatattttaataactactgtgtcaataatctcataaaaaataaaagactaattttttcattaaacttctaaagtaattatctaaataaaaaagttactagatacatatgtaaatcgtatacccttaacgccttataaaaaataatagtttatcatattataataaaaggacttactcctttattaaggattagtcccttttaaatctttttttacttctattcatcattttcaatacgattaaaatacaatttattatgcaaatatgatggatcatttggtttacattttcctgccaattcattgtaatattttgctgttttataattacttagcttatcataacataaacataattgcatatagggaatataatcataacaatctggagatataaatgctccagatgtatcatcacgctcacacgataatgctactgcactccaatagatagattgctcatactgcttcaattcaaagaaatacttacctaaatcacagcatatctctgctcttggcaaatcatagcaaagactatttaaaagccaggttattgcttcttgcatatcaccaagattgtaaaaacaatagcctaaaaattgacaggcagaaatgttattttctttccatcccttcttggtatttaaaaatcttttaaattcagctactgcttcttgatacaattgatgataaaacagctcccgagcataatagaaaatttctcgtggactaaacattaccccttcattcaatttttctctaaatattcttaaattacgattaacatcactatttttcaccttactatgtgtaattgcaagatcactataaagcaccttacctctaggacttattacttcatgtataaatccttcccaataaaaattatcctttcttcttaataatctttcacgataatacgtaaatgtcggcttattattctgatcaaattctgcattatatttcatcataactacagaagtatcttttgataaagtttttttaagattaatcaaaccttcttgatcgctatctgaaataatatcatccgcgtctaaccacatgcagtaatccatagttgcctttgaaaatgaataattccttgctttagcaaaatcatcacaccatacaaaatcatatactttatcagtatatttcaatgctatctttttagttcgatcagtcgatccggtatccacaatgattatttcatctgcaatcctttcaaccgattttaaagctctctctaataccatttcctcatcttttacgatcatacacacactaatagttatcatatatttcaccactataatatatgtcaacaacccttaaaatgtgaaaatatttaaaacaaaaaatgttctaaataaagaacatttctaaataatcttagttgagcattcttctaaattaattacttcatcaacaattggtaaataaaattccggttcatgactaactaaaataacagctcctttaaaagccttgattgcgctttgtaaagaatctttagcatcaacgtccaaatgatttgtcggttcatctaacaccaaaacattagcttcacgattcataatcttacataatctaactttggcattttctccacccgataaaactttcattaaagattcaatatgatcagttgttaaaccacacttagctaacatagctctaatctcaccattgtttcgatctggaaattcctcccacaaatagtctaatgcagtttgggaaactgcagattcttcttgtttaaaaaaaccaatttcaacaaatggatctttttctactgttccactataaggtttttgcatcccaatcagcgtctttagtagagttgtctttcccaaaccattgacacctttaatagcaactttcttatttctttcaaaaacaagattcatttctttcgttaaaggactatcatatccaatcactaaatccttacaatcaaataatactttacctggtgttctagcttctataaaagaaaaagtcggttttattttttcctttggtttagaaataagattcatcttatctaatttcttttgtcgtgaactagccatattacgagtagctacccgtgctttattacgtgcgataaaatcttcaagatcagcaatttctttttgctgcttttgataatcagcagctaactgacgttttttcaattcaacttgttgtaaatagtagtcataatcacctttataacgagtcaatacaccatcttctaaatgataaataatattaataacttgatttaaaaaactaacatcatgactgactaaaataaaagcattatcataattctttaaaaaattgattaaccaattgatatgctgctcatctaaatagttagttggttcatcaagaattaaaatcattggattctctaataataatttagttagtaaaacttttgaacgttgcccaccagatagcgcatcaaccggtttatctaaaccaatatcattcaaccctagaccacctgcaacttctttgattttaacatcaattgtataaaacccgccatgatctaaaatttcttgaatttcaccaacttcttccatcaactgattcatcgtttcatcatcacaatcagccatttgttcatacatcgataacatctccgcttctagatcataataatatttaaaagcatcttgtaatgtttcatatatagtttttcctgggtgtaaagctgtgtgttggtctaaataacctgttgaaattcttttacaccattcaatctttcctgaatccggagcaatcttaccagtaataatatttaaaaaagtagatttcccctcaccattagcacctactaaaccgatatgttcgccatttaataatctaaaacttgcattttctaaaatagttcttccaccaaaatcatgactgacattttccacacttaatatactcattttctacctcaacttgcaatattaaaggaagattatcatcttcctaattcaactatattatacattaaaattactaactgtcgagtctaaacaatcactcaattgaaaagccatagtatccattctttccattctctttaacataatataaataataatctgcattattaattaattcctctttagataaacaattactaaaagaattataatatccagatgaaatagtgattttatcatacccatataactcaaatttactataaacttgttcaataaaactaattatcatttgctcattacaatctacacaaatacaaataaattcatcaccgccaaaacgacaagaaattattctatcatcatcttgttgtaaactatcagcaaaatcctttaatatttgatcaccagttaaatgacctaaactatcattgtattctttaaaatgatccaaatcaaaaataataattcctaatagtcgacttttatttttaaactcactatatttataatgaaaatatcgtcggttataaatcttagttaaatcatctagtctagactccttaacgatatcttttttttcttccattgctttaaatagttcaattttatataaaacactatttaaacaaaaatcaatactttctttttgattttcatgcatcaaataataatattgttcatataatttaggcaactgttctttttcttcaaaaacaatacaatactttatcttcatttctaacatttcaatttgataacgcattccagttttaccaaaatcattctcctttaataaaagataaagacattttgtccgctccttatccttgattgcaaaagtaatatacaataaaatatgatgaataaaataaattgcttcatttgcacgaaaaccatgaatctcattccctaatatattatcaataaactctaaagcttttgctacatcaccatgcccatagcaaattaatgcttttaatgcttgccataaccgatcaatcggatcaaatgaagtatcattaaataaatccttattttcttccattagagcaattgcttgatccaatcttcttttttcacaataaattataataagataacataacacaaaacgttttattttatattccggcagtttaggagaaatctttttgatctgttcaagcgattctaaaaaataaggtaacgctaaatcaaattgacctaaattaacaaaaacatctcctaaattacagttaaattttgctttcattatatagtcatttaactgctcagctaacttcaatcctttgagataaaaaccagtagcaagagaataatcattattacatactgcaatagcatataggttgtaagcctgcatcaataaatctggataccctttttcttcatttagagccaacatctcattcgctaatttaactgtttcttgttgcgatttacaagaataatagtaatcgattatgtaattactagctaaacataatatgtaatcatctttttgttctagtgctatttcttttaactgcaaacatttttgatacattttctcgatatcatcaaactgtaaatgacggatttcttcgactaaacgatctatctcacgcattaatttctcctttctttaagcactttgatttcattataacataagatagttctaatattggttaaaaaattcctagttttaactaggaatcgtatatctaattatttaaaaaatgttttataatcttcataattttttttcaacaattcaggtgtatttaatccatacggacaatgcgacatacatttgccacaattaatacaattttctatttttttcatttcttcttgccaatgttctgacaaccagcctgcactaggagctcgtcgtaacatcaaagacattcgagcacactgattaatttctattcccattggacatggcatacaatatccgcaaccccgacaaaattcaccagataactctttttgatcatgagcaattatcgctttgatttcttcactcataattggtggattatcattatactcaataaattcatctaactctgattctttttgaattccccaaatcggcaatgtattatcaaactgcgctaaatacgcatatgccgcatcagaacggtctattaaaccacctgacaaagccttcatacaaataaaaccaacatctttttctttacataaatcaactagttcctcttccttttttgaagccaaataactaaaaggaaattgtaaagtatcatataaaccacactcaacagcttctcttgctacatgtaaacgatgattggttaaaccaatatatctaatttttccttgtttcttagcctctagcatagcttcatataaacctgatccatcccctggcttaggacaaaacgacggattatgaaattgataaatatcaatgtaatctgtctttaataacgataaacttgtttctaaatccttccaaaaatccgttactgtcgttgccatcgtttttgttgaaatataaattttttggcgtacctcactaagagcctcaccaatcttttcttcactatcactataagcccgagcagaatcaaaaaaagtaattccattatcatatgctttctttaaaataacttttgcttcttccatatttactcgttgaacaggtaaagccccaaaaccatttcgattaacaacaatatttgttctccccaatcttactgtttccattttcatcctcctacaattcgacatttcctatttttattatactcccttgagtaaactttaagtcaagtaaaaaacgaaaggttttaacctttcgtttcatcaaaattatgattaataatttctaataatctgaactcattatcttcaaattcaaattttaaaatacaacaattcttcaagccgcctttttggtcaacttgactagtttcctgccaatatctcataaaaccacgacatgccccaccatgagaaactgcaagcacaactttatgatcttccttctgcataatttctaataatgtatcagcaattctttggcgcatctgtaattctccttcaccgccataattgacaaaaaaatcaccatatggcagcggcggatttaaatcttcactttcaccttcatatattccaaaattccattcctttagtcctttgactcggtgataaggtaaatcacagactaactctaaagtatcacacgcccgctcagaagttgaactataagcatgatcaaaaacgatgttattgtctttaaaatattttcctgctatcttagcttgtttaattcctaactctgtcaaaggggcatcacaccacccttgaatttttttacgagcattaaatagcgtttgcccgtgacgcattaaatatagagtcttcttcacccgatcagtctcctatttttactattttatttgtggaaaaaccacaaccaataacattttaaatgcttcttgaccatatacagaatgcggtttattagccggcataactaatgtttcaccacgctttaagacatattcttgaccatcaactgtaaactttccaacaccctctagcacggttaccatcgcatctccgctagagccatgcgttccaatttcttcacctttatcaaaagaaaaaatagtaatacttaaagcatcattttgtgctagtgtcttactaactacttgtcccgcttgaacttccacttgcgatgctaatgtagttatttgttcatggggaatatttttaataaatatatcgctcatatcttacctcctatcaatatttattcccaagatatgtttatattatagcataaaagttaaataaagcgattaacgatactgcttcactttaaaatgatagtttactatcttattaagataatctaaatcatttaaatcctgaataaatcttgtggttagctctaagtcaagataaaataaaaaagtgtaatctcgttttttatttatataaaaagcgaggattgatcattaataagaagttataataaagagggtaatataaatggaatggattgaacggctaaatacaacaattgaatatatcgaaaatcatttaacagaaaaaattgattatgagcagctcgctaaaatagctggctgccctagttatcactttcaaaaaactttcctttacatgactaatatctcattatcagaatatattcgcaaacgatgtatttctttagctgcagttgatttacaaacaggagaagacaaaatcattgatatagctttaaaatatggatatgaatcaccaaccgcattcaaccgtgctttccaagcagttcatggaattgcaccctcacttgttagaaagaaaaatgttcaaatcaagtcattcccagctctaaaatttaccttttcaattcaaggtcttgatgaattaagttttagaattgaaaaaaaggatagctttaaaatcctaggaatcagctctcttttaagtaaagaattactagaaaactttgtccaaatccctaagcaatgggacaaagcattaaatgatggaacccttaaccaactttatcgacttaataatcagactccgctaggattattaggagtcaatattcatcaacacgaagactggcgttatttcattgctgttagttcaactaatcataatcaaaattttgaagaatatcatatcggcagcgctacctgggccatcttttctggtcacggaacaaatagaactcttcaagagcttcagcgtcgtgttattacagagtggttgcctacttccggatatgaatatgctaatatcccagatatagaagtttatctaaaagccgatccaaatgatgccatttacgaatactggttaccaattataaaaaaataaggagttatgttatggtaattacaaatattaaggcctcttttcctaacgatataaaaactatttggaatattgttacttccctagataattatacttggcgcagtgatctttcaaaactggaaattatcaaatcacaagagcaatttatcgaatacactaaaaatggttatccaacaacttttacgattacctgttttagaccctaccagcgttatgaattcagtatggaaaacagtaatatgaaaggtcactggataggattattttcatctcacaatggtattacttcaattgattttacagaaaatatcacacctaaaaaattcttcatgaaaccctttgtcaaaagatatttaaaaaaacagcaagctgcttatattcgtgatttaacagctgtcttagaagcaatagaacatcgattttaataacaatcccaattatacaagacttttgagaaattcttattctctaagtctttttttgttataaagaaattacaaataccactatccccccacataatctctttatcaccaatacctacactatcaatttgtagtaataaaatataatcatcgtacttttcactactgcgggggtcttcttgagtaaatgcaggatatccaaacattttatgcccaaaaccgctaaattcattaaattcatcctcatacaaaatttcatccggtaaatcataatatgatgaaattaaattatttgggtataagttattccattcttgtgtaaataaaccatcaaaatgataatcaccaatacttattccttcttcgccaccaataaaatgcagcttaaagttatcaactattggaaaataaccctcaccttcaggatgatatttattaagtatctgactttcagatacagttttatcaatacttgaataataaataacccgactttctgcttgcgatatcatattctcaaaatctaaaccataaagatcattatccatagcccaaaattgcaataaccctgcttctaattgataactattcatcggtaaatcagcaaaattaatttgccccagcaatcgtaattgtttattatctgtacttaatggtacttcgtcatctactcctaagtatggtaatcccccaaatttactatcaaaaatactacactcatcattacttaattcaattttaataacatctctttgagtatagtctgtaatcaccttcatcgtacttaaaaacatttctttattcatttctagttttcctgactcttcgactgaatcttttttctttttaaaaaaatcaaacactcaccatcactcctttcactaaaacataaaacagcagcttccattatcatttctttatttaattttagcaccttcttaaaaacaagcaaacaaaaaacatctcgataatttataatccgattaccgaaatgctttttaaatatctaaaaattataattttaaatcatgcatggcaattacttcgaccaataaagcaataccaccaacaagtaaataagcagctacaatataatttaatacgacggttgacatcaatggcgcaataataaatgctaaagctgctaaaacattgattatacccgtaaatataacccaaccataactttcaattccaaaaaagcttaattgatgagcaaaactcaacttattaagcccataaaccattaaaataaatccaaaaataaaagcaaatgtattaattgtcatttcaattggtgaacatatcaacaaaagaccaattaataaattacaaatagcgcttacaaggccacctggaccacgaaataatggtggtgccgctatataatcaatgatctgataaattcctaaaataagaattaacccggttgcaatcgtaccaattatagtaactgattttactggataaatcatgcatagaatagcacaaataatcattaaaatagcaacaataattcctgctactcttaatgagtgaatctttttattccactttccaacaaattcacttcgaaaatcaaaatcatcattaaatcttaacatctctatcaccttctatacttatattatagtcttcaaaaaataaaataatataaacaaatttgtccttttgtctaaaaaatcctatactataattggtttattatgttcagatacggtatattaagcactgcttcaatcattgatcgttttattgcagggattagagaaagccaagatagctatgttcaagcaattgcatcaagaaatttagaaactgccaaaaaagcagcaaaacgattaaacattgaaaattattatggcagttatggtgaattgctttgtgcaaataatattgatattgtttatattcctacagttaacagtcaacactatgaaaactgcaaaaaagctctaaaacaccataaacatgttattgtagaaaaaccttttgctttaactgtcttagaagctaaagaattattcacattagctaaaaaaataattgttttttaatggaagcacaaaaggctctctatcttcccacaacaagtaaagttaaagaattaatcaatagtgagataatcggaaaaattaaatacttagaatttaaggctgggtttccaggtcgctttacttacgatcactggatgtatgatctatcattaggtggtggtgctctttatggaagtgctacttatacaattgaatatctccaatatctttttgatcatccaaatttaacaattgatggtacatgtatcaagtgctctactggagcagatgaaatatgtaatttccaattgaagataaataatagtattcttgcttcttcaacaatcgctatgaatgtggcattaaaaaatgaagctgttttttatggagaactaggttatatcgttgttcctaattattggaaatctaatcagttagatctttatctcgatgatggcagtcatagtcattatgattttccttatcaaagtgaatttgtttatgaaattgaacatattcatcaatgtattaataatggtcgattagaaagtcctatcatgaataaagaaaaaactattgaaacaattaaacttgttgaacagttatatcaaaaatggaaataaaagaatctttgccataataaaatgaacctccattacttgtaatgtgtaccctccttactgatttgttcagtaaagagggtacacatcattgggtgtccaaataatggaagttcatttcaaattagaactaaaactttttattattagtaacagtggcataaaaagccacccccaaaataatcactcctccaagcagttcctttactccaggaatctcatgtaacaaaaatatcgcaaaaataatgctatacacactctccattcccgatattatccctgcagtttgcacctttactttctttaaactactgacataaatgctatgagcaacagccgtacatataactcctagaaaaataagcgcaaataaatcaagttttgttattgaagctttaactatcagcaatgacggtaataatataatcgcagcaattccttgttcatataagcaaatcgttctccctgtatatttacctgcaaaatagcgattcatcaagcataacaccgcataacttaaagatccgattaatccaataaagattcccagtgttatttgattgttaagtgagaactctggaattgtaattattaccccagcaaacattgttagcgcaatcattatattttttattctaagctcttcatgatatactagcggttctaaaaaagtcacaaaaagtggaaaagttgaaaaagtaattgttccaattgcaacagttgataattgaattgcttgtaaaaaagtgaaccagtgaagtgccataacaataccagcagcgatgattagaatataatcttttttattactcaatctaactttctctttttttattaaaattattattaatagaaaaattgaagaaaaagatactcgtccaaaggtaatcaaaatagctggtagtgtgacaaattttccaattactccggctaagccaaataacataacagccaaatgtaataatccaacttcttttttcatcactttcccctcctatttatagttaataatagtttagctcatttttaataagaaaaaaagataaaccacctatatcatcgctgtccattttctaaactaaaatgcaaggccaataactacttaaaaaccttcattataattagttattaataaaatatttaattcgttcaatcgttgactgagtttcaagatattcaggatacagaacttcaaaaacatgtcctaaatgttttccttagagcaacacacggttcaaacataccagttataagccttcaatacatttttagcctttattgactaaaaatgtaagttatctcactactaataatacgtgttgaaagtggcggtaactatcaattacatcaataaggcaagcttttcgatatatgtctgaatcttcattgttaactccctgaaccataacactaacctactgataaacaaaatttttactgttagtcaaaacttattaaatcatctccaccatgtaacaaaactctctaatcataatttctggtggctgaacattatatactttacagagctcaggctgttttatgattgcataaaccaatcctgctaaatgcccaccagctgaatcactcagtaaaaataatttgatcaatattccaaaaatatttattctttgttttagcaacaaactttaaagtcataataatttcctgaacttactgcttcaacgaggcttgtggtattagagtataatttatattcacaacagtaaaatttttagcagctagcataactgcaaatttttatttactcctttatcaccataaatccaggcatcaccgtgaacatcaatgatcatagacaatggcttagtcgtggattaaggataataaatatctagtaaatgattatgattcctgtcatcttgataaggaatatcaactacttagtggacattttcgagaatagtaaaaatatcattactttttggttgcattttaaaacgagcaaacttaataattgatggataaaatagatttatacctatcatctcctcattgaattattaataccacactattatgatactctttagccccattttctctatattatcgtaaaaaaagcatcatttttaaaatgataccttttaaataacatataaaattatacataagaaatgtaacacacttcctaataagatccataaatgccaaatactatgcatatagcgatacttattttgcaaaccataaaaaacggtaccaatcgtataagctacaccaccagccacaagtaaccaaattccattatatccaatagcttccggcaatagattgaatttaaagataatacaccagcccatcgctaaataacaaatcattgaaaacttttcattactttcaatatcaattgcatttaaaatgattcctagaaccgtacagccccaaacaacagcaaagatcatccaagcccaaaatgaatctactggtcttatcgaacacaacacaataggtgtataagtaccagcaatcaatacaaaaattgaacagtgatccataatttgaaacacttttttactcttagtatttggggaaagcccatgataaatactactcattgtatatagcaagatcattgatattccataaataattcctgaagctataccataattgttatggcgcaatactccaaaaacaatacaaagtactaatacggcaattccaaaaactccacctacaatatgagtaaccatattaaaaatttcttcacctcgagtatactcgggtaatactcgatcatctaattttgttcgtttcattgaatacccccaatctatatgtatgaatatagccctatttcatgttaatttcaagaacatcatataataacttcttataaatttctttgataaaaccaaacttagtcacagtatttgcctgtcgattgcaaaaatattgttttgctaaaaatctttaattatccatttttaccttactgctataaaatatttagatatttaacaaattaaactaaataatcatattttctaactttattatgacaatgtatacagctaaaagatatgtgttccctccccgcaaaataaataataattaaaattaccatgctggattccacaatagcgataaccagctttttgtatttgtttaaacagtttgatttattttcatccttcaacaaatagttttcaataaaatcatttaaatttctatgataagcactaatataaaagttcacctatttttattccatatcccagtcttgtcctcaaatatataactgttttgaagattttctactattttaatttctttattaaaattatttatactgtaactctcttttaaattttctaatttgactaataaatagatcattattttgtaaagaaatataaaaatctttttgctctgtaacaatattgagccgatccaaagaattagctgatgatgcaattgcatcacgacttttctctattcttataatttgttgataataaattccaaaatcttcagtaatccccctttccttttaatcctgattaaaatagtctttaaacaatttaatttattataacaccctaattagctgattcatcatttctatcacttaacgattcttcatcataaaaatatatcttaaaaagaccatttgactcaaattctcatttttcaaattactcctttatcgatataagtatatattgctaatcataacaaaacaaagatattctaattttgtaagtaaaattaccttgcttgattactttaccatccttagttaattctaaaacaaagacaatcactatccatatcctcaatctaattatattatctcataatcaataatctatcacgaattaaaagatgcctaacggcatcttaaactgctaaatcaaattatctagtcttttccatcaaataattagttaaataaacattatccactttgactgactgttctttaataactttatatcctcttttttcaaaaaaaggcttagcacttatggaagcatgaactgttaaactttttacatctttacaatactgttctaacttatcacatagctttgttgcaatctgttttccttgataatctttatgtacgtataaatgatctaaataacctctcttatcaatattaccataacccaaaaccttttcattttcaacagctacaagagtatacatagagttaaaaaagtcatcttgagtcagcagaaaattactccgatttgaccatactttgatttgatcattattgtaatcatatctatttattgtattaatcgtttcataaaacaattcacaaattacttttaaatccgaagactgatattttctaatttccatcgatttcaccattaataattttataaactctcttttttacttcacctaaatcttccttacgtaataaagggagagatcacatagtttttcttattcataatcttatcattttaaccatcccaacaattcgatcatttcattaccaaaacattcttgtctaaaatgagccgaattctctccaataacagaatatgctgaaatatctttcattacaactgaatgaattacaataatccttccatcatcattttggcgcataatcatatttaaaattaccattaaatatttatatagtaaactgcaattatatcattccttttacttctttaattaaattaaaattccattacaatgatctatttcatgttgaatgatctgagctgtataattactaaaagtttttattttctttttgaaatcaacatcataatatgctacttttatcttttcgtatcgctttgtctttttcactccaatatgtgatagacatccttcttctgtttcatataaacgtcccatagtttttataatttctggatttaacattactaaataattaccatcatcgtttacaatgataatatttttattgataccaatcatattagctgccattcctacacaacctgtagcatgagctataatcgtatctaataaatcttgaacaaccggtaaatcctctttagtagctggaagtgatttttgacttagtctaaattgatcactaactatttctcttatcatttattttcccctttatattgtcttagcaaagcttgatgtttctttaataatgaagctgaatatactttctttcctggctgatctctaataaccttccacaatatcgaagcagctttcaatttattataataaattttattattttcatcacgacaaaaatcttttaaaaactgattccactgacaagctgaattatcatatttagcataatcactttttccataatacacatctaaaagatccttgagcgtgaaatgaacattcccctcacttcgaacccttctcaatgcagttgccatatctgcggtgaacttaaaattaggtgtttttgtaatttcgccaaagaattcacgaaaacgtccattaagaacaaagccacattctaataattttgtttctaaggttaaaggcacatcttgcttccttattttcattcgttttactggtttaattatttcaccattaaaataggctttaatattatcattcagttccgttttagtacctgtatgagtaattccgtgttctttacaaatttgttttagttcatcacgataccaataatactgtttaaattcatcaaaactttgaatatcattaaaatttggacgtgtcatttatattctccacccctgtcttttaatatcatatcatctatagctatttatctcaataaaaccatatatcatctttatatagttcacccccttagttggaaatccaactaagaggttcaatttcattattattaaaaatcatttagataaacagattagcacacatagtgaagatagaacaaattatgattccggttacagctggaactaagaaagatacaatcgcccatttccaactattagcttctttttttattgttaaaagtgttgtcgaacaaggccagtgcattaatgaaaataacattacattaattgcagtgatccacgtccagccattttctactaataaactttttaacattactaaattatccatttcaatcaaactaccactagcgaggtatgccataatcatgataggaattactatttcgttagcgggaaaccctaaaataaatgctaacaaaataacgccatctagaccaatgcatttagcaaagggatccagaaaattagaagtaatatttaaaattgtcataccatcaacactaatgtttgccattaaccaaataataagaccagcaggagcagctactgccacagctcgagataaaacaaataatgttcggtcaaaaattgatctaacaatcactttgccaacttgaggtttacgatatggtggtaattctaaagtaaatgaagatgggactccctttaatatagttttagataataactttgaaataatcaaagtcatagttattcctaaaacaattaacattgttaaaaatattgctgataatagagaattttgcatagttgcttcggttccaataaagaacattgttaagattgctatcaaggttggaaaacgaccattacatggcacaaaattattagtaatcattgcaattaatctctctcgtggtgaatcaataatccgacatcctactattccagcagcattacatccaaatcccatacacatcgttaaagcttgtttaccacaagcgctgcattttttaaatgcatgatcaagattaaaagcaattcttggtaaatagcctaaatcttccatcaaagtaaacaatggaaaaaagattgccattggtggcagcataacacttacaacccaagctaacaccctatataccccagatacaagcatatcactaagccatagcggcgtcccaataaaatgaaagaactgattaaaaggtacttctaatccaaataagaaatccgataaccactgcgatggatagtttgcccctgttatagttatccaaaatattaaagcaagtaataaaatcatgattggataccccgtccagcgatttgttaaaatcttgtctatctgacgatccctttgattataatcttgcttttgatagtgaaccactttttgacaaatcaaatgagcactgtgaataaatgaaacaacaatcttgtcttgtaaattatccttatttatatcatgttgtgctaataattcatttgcttggtcgatagcttctttaagctcttgatcatcgtagtccagtcctaattgatttgacatttcaatcattaaggaaggatcgttttcaatcaatcttaagctaagccactgataacttaaagaagtagttactttcttttgcaatacttcctcaacaattcttattgcttgtaataaaatatcactataagctatttttaaggatttgtaattaactggtctatcgattgcttgatctaaagaatcaataactttatgcaaatctgtcttttttctggcagtaatcccaattacaggaactcccaagcaagatgataattgctcaagatcaatatcaattccttttttcttagcttcatctaacaaattaacacaaactattacatttgtatgaatttcaattgtctgaattactaaatttaagttacgttctaaacaagttgcatcacatacaacaacaattacatctggatgctcaaagcaaataaaattacgtgctacttcttcttccgctgaatgtgctaataatgaatatgtcccaggaatatctactaaaacatatgaattttcttttcctcgacaatagccttgagcattagtaactgttttaccaggccagttaccagtatgttgatgaaggcctgttagcccattgaaaacagtgctttttccaacattaggattacctgcaatggcaacaactttatcatttctactttgtttttttattactaactttgtctcacttgcattaattcctgtagatttgttagttaagcccataattcacatcatcttttctaattaaaacattttgacaatcttcattccgtaaagcaattactgcacccctgatcaaaaaagctttaggatcttgacttggactattcaaaatacattgtacttccgtatcatcaactaagccaatatctaaaagtcttcttttaatactcccttgtgccattaatgaagtaatcactcctacttcacccatttgtaaatcatttaaacatctattttctatcataataaatttctcctcatcgtatattagattaaggaaactttgtttcctaatactataatattaaattactagtaaagcgttactaaaaaggagaaaaaaatgaataacgatgaaaatgcctattttactttcaagggctatcaattgaataatgacagtaacttaacttcttcaatggaagattatttagaaatgatcattcgcttaaaagaaaaacaacccttcgttagaatcaacgaattggccaataatcttaatgttagaccctcatccgcctctaaaatggtaactaaattaagtcaagaaggctttttagaatatcaaaaatatggaattatcacgttaactgaattaggtaaacaatggggtgaatattttatatatcgtcatcaggtattaaataactttctctgtctactcaataacagtcataacgaactagaacaagttgagaaaattgaacactttcttaataaaaaaacaattgataatttagccttgcttactaaagaacttcacaatctacaataaaaacaacaatatgggaacaaatccattaccatactgtcgtcttactttttatcgaataaaattagtgaatttatgctcctctttttccggtaatccaaattcctttttacctaattgaatacttttaattaaaaaagccatattcttaccaagagttctcatcgtttgtagtccttcaaggtcctgctgtacttcttctggtgaattaccatgtaccatattccaatattggctagaggctatcggcatttgagaaatagtaaaatatttatttaattcatcaaatgtagcactattaccccctcgacgacaactaactacagccgccccaactttcattgttttatcagcagtcatactataaaataaccgatcaataaatgatactaaggttccatttgccgacgcaaaataaactggtgaaccaataacaataccatcacattctttaaattttggtgcaatatcattaacaatatcattaaatacacatttccctttcgtcttacattgacgacaaccgatacatccacgaatatctttatgaccaacatgaataatctcagtttcaatcccttcactctttaaggtttttgatacttcctctaaggctgtatacgtacatcctttagcatttggacttccattaattaaaataactttcatttttctatcctccttgatttctctttttatttatcttacaattatattgtaatactcggtagttactaccggtcaataattttttaaaataaatcaaaaatagaggtatttattatgtgtacgatgaaagaagtatgtaaagaaattggtatgaattatgaaacattaaagttttattgtaaagaaggtcttgttcctaatgtaaaacgagataaaaataattatcgtaattttgatgagaaaaatattgcctggttaaaaggaattcaatgtttaagaaaatgtggattaggcgtaagtgaaataaaaatatatatgaattattgtttacaagggccaacttcaattccccaacgtaaagatatgcttagccaaacaaaagaacatttgttaaaaagaattgcagaaataaatgagtgtattgaatatatcgataataaacaaagcttttacgatgacgtacttgaaggaaaatgcaggtacacaagtaatcttattgaaataaatgagtaaatagctttgataattaccactttaagaaaataagtctttatcttttgtcactaaaagataaagacttatttctatattagaaatatcctactcttcttcaataaaatcaacacataattttgtaattccgcttaacatataagagctggcttctttaatataataaaattcaggtaaaaattctttatcaataaaagaggatagcacattttttacttcatccatatccggtgtcattggtgaacttatcactacagcttcgggtccaatgagcgaaatagttggaagtaacgattttgttacgagctctacggctccatgctgtgtccaagccagtttatgaacatcatcagataattgcatccgtcggataaaatatcttatctcacctgctataccatttttccctctaattactttaccattagaaattattccttgtccccctaccccaaatccaaatggctgtgaatggaaaataatattatcatactctggatgttctaaagaaaaacctacaactgctgcatttgcattattataaacaaaaacatcaattccatatttatcttcaaaatcagcttttatatcaatagttcttccatctgttggttctttcaactgcttttcatctttaacaatacccggtgtcgcaattccaatcatatcaatgtaagaatgttttaataaaatggtatcaataatatcgtagagatcgtatatattcattgtaggtttaatgacaaggttactatcaattatttcacatttatcatttaaccgataataaatacgtgtctgctctctactaatcaaaataacaattgataagatacgattttcatattctgcacaatgggtacattcatgcgcttgctcattacttttttcttggcggaaaatctcaagctcactttgaataaactttaaagcagctaaagcatcatacgaagcaaataccgatgttggtatttgtaataccggcttttctgtgatactctcttttaaacgtttgagcatatacccaatttgtggtgcaattaaaattacatcatacttttctgcttcttcataaatactcatataagatactgcatcaaaatggtaatctaaccctaacattcctgctacagaatttaaattatcagcaaacatagaagttgtaagtcctgccgaacatgataataaaacacgcaaagttttttcttcttttaacccaatcaatgtttcaaccatctcatcatataattgctttgcatgattttcatcattgagttcaaaatgaagatagaatttaacagaatgatccttatttgaaacaatactaaattcaacgattgtatattcctcaattactgtaaattgaatcgatgcctcaccgtattcagttactaatttaataagatcatcgttttctaaacgaatctcatatggagtattatgatgctctcgaatccaacctttaaaatcaaaaactgcctttttttcagtcattttatccctcttttctctttataattttattttaacatccataataatgaacatcaaataacattatctttatgaccaaataaaaagacgatacaatattaattaacttaattgtaaagtcttttttattcaacatatttacgattgtctttgccaaaagtaaatggcatcatctatccaaccttcagctattgttcctgtgcctaagccaaatccatgtgatagacccttataacaatgaaactcagttggaatatttaatttatttaggtgctctaaccgttttttcataagaatatgatctgcaatataatcgtttgttccaatacatgcataagttggagcatcttcatttgaaacataatcataccctgtatactgcataatgacagcttcggctgaagggacagcaatttcactatatgaagataaaaactttttatttcccaatactgctgccattctagcaccagctgacccaccccaaagtgaatagtgtcttttatctattttcagcatattcgcattattatatataaacgaaatagccttagctaaatcttcatacggatgctcaacacgataaatcaaagcaaaagcattgtacccacgcttacttaactctaaagcatgtggaaaactatcatgcattgctcctacatatacaaaaccaccaccagcattgcatattgcaaaaggcgcatctttacttcctttaaaaaagaacaatcctacatctctttttgaagcatcatttaataattcttctttagaataaatgttataaaatattgaatgattttgagcatcgtgattgagtgtatttataatctcaattgtcttattcacatctatataattataccataaataaattttagacgaacttaattctttaatcgtcatatttagagctatcggtctattgattggaaatagtaaccttccccatgttttaaaggctggaagttctaatacttcttgaatagtagtattagaacttatattcatttttaatgtccgccgaagacatcaaaatcaattgtatctaataaagcatcaatttctttgatttcatcaattgtaacttcaatttcccctgctctaaaattttcttctaaacgttctaattttctgcttcccgggataggcacaataaaatccttttttcttagcatccatgctattgaaagttgagccatagtacaatttttcttttctgataatacttttaacaaattcaataatttttttgctttttcatacccttctttttgatattgaggcatattatttctaaaatcccctttttcaaaggtagaatctggtgtaaatttccctgaaagtaatccattagccattggagaaaaagctacataagttattcctaactctttacaaacaacgaataaatcttcataccatctagccatcattgaatatctattttgaatagctgtaactgggcaaacagcatgtgctcttcttaaatattcttctgttgtctccgaaattccccatgctttaattttacccgctgcaatcaattccttcataactccagccactacttcaggttcaactttaggatctatcctatgttgataatataaatcaatataatcagtctgtaatttctttaatgatccttctatcgatgcatatattttttctggtgaggaatctaattctaaatgatcccctttatgttcaactccaaatttagttgcaataacaacctgttctcttacctcctttaatgcttcacctacaagctcttcattataagaaatagttccatcagtattctcaccagtataacattcagccgtatcaaaaaaattataacccattttataagcctgcttaatagtttgaattgctctctctttatcttcagctaagccataagcatgagaaaatcccatacagcctaatcctatcggactgacatacatattcgttttccctaactgtctttttatcatcatagcattatcctttcttattcagtaatcatcccacgataattcattccatataaatttgcaaaacgctgcattgtatattcccctgcttctaattgttgtttcgttggagcataaccttggaagataaaatacatgtttttaccctttaataaactttcatcaacatgttgataaaaccggtctaatagattacgaacagctccagacatactatgccaataaagcggtgagccaattacaattgtatcagctttactcatcgctaaaacaacttcatcaaattgatcatctgtaaaatgctgaccataactataaatcttataatctactaaatgcaatgtctgataatttttaccctttagaaattgctcacttaaagcaaccgtattaccatttttattaggacttccgttaataaataatatactcatttttttcactcctttaataatctattttttattcatggattttcctatgaacaaccatccttacaaaatcaggttcaaagtgtttagcccgtgaaccactatatcccatatctaaggatgaaatttttttcatctcatcattattcaactcaaaatcaaatacattaatattttcaataattctctctatatgagttgatttagggattacaacaacatctctttgaatattccaccgaagtaatacttgacccactgtcttatgatatttttcagcaattccttttaacatctcatcttcaaaaggattatatctaccgcctcctaatggtgcccatgcttcaggaacaacatcataatatttcattgtctctattgcttgctcctgagtaaaatatggatgcagttctatctggttaaccattggcttaatttctacaatttcacaaaaattcgttaatatatttggatagaaattagaaacacctatagctcttaactttcctttatgatatgcatcttccatagcccgccatgcagcaaagtaatctcccattgcttgatgaagtaaatataaatcaaaatattccaatccactttttttcaatgaattttcaattccctgttttgctgtttcatatgttcgcatatcttgcacccataattttgatgtaataaacagctcttctctcgtacagattcccgcttcaatagcttgcttaacagcatttcctacagcatcttcattcatataagaagctgctgtatcaattaatcgataccccgctttaattgcttgaaatacagtttcttgacattcttttttatccggtacttgaaatacccctaaacctaaaattggcatttctatttgattatttaaaataatatattccataatcttatcccccttattattcctcaccgtcaacatctggaattgttgttgccagtatatgctgtgatttttcagttatttgataaaatggacaatgtttatttagttttgctatttcatacatttcttcatttgttagtacaaaatcaaataactcgatattttctaaaatgtgattagcacttctacttcccggtactgcactaaaccccatttgcgtgtgccatttcaaaataatttgagacgttgtcttatgatatttaattgctaatgctttaaataacggttcatttaacaattcattactaccatgccctaaaggataccatgattgtagaataatcccattttcaaaacaaaaatcttttaccttttcagccggataataaggatgacattcaatttgcattactactggtttaatttcacaaatatccaaaatttcttgaatttgttcaaccttaaaattagataaccctagtgctttgattttcccctccttataagctttttccatcatttgataacccgcaatataattatttaaagggtgatgcaacagcatcagatcaatatattcaactcccaaccgttctaatgtttgctcaacagcattacttttttcataaaacgtcggagctaattttgtctcaataaaaatttcttttctatccaatccacttttactaatacctctacctacacttttttcattagtatagcgattagctgtatcgatcaaacgatacccattttgtaaagcaaaagaaacattatcttctacttgtttaccaaactgtccaattgttccaaaaccaatgatcggcatcttcacaccattactcaattcaattattctcattaatattttacctcctagtatattgtagattctgactagttcactataaagctatctagctttcatcttgctttaataatttatctttttaaaccacagatcatctcaacagttgctggatcatagtgagagaaaaatgaactcgtatctttattcatatttgtaatagttttcatatcttcttcacttaattgaaaatcaaaaatatcaatattttctaacattctttcttttctcaccgttttagctaatggcacaattcctctttggactaaccatcttaaaattacttgacctactgatttgttatatttttcaccaatttccattaatgtttcattagtgaagattcccttctttccctctgcaaacggtgcccatgcttctaattgaacaccatatttttgattatattctaatgcttgattctgttgatgaaatagatttacttccacctgattcactgcaggaacaacatctgtatctaaacataaatctactaaacggtccggataaaaattagatacaccaaccgctttaatttttccttctttgtataaatcaactaaagcccgataagcaccatgataatctttaaaaggctgatgcaataatactaggtcaatataatcgagtttcatcttttctaaagattcctccaccgatgccttagctttttcatagccatagtttgtaatccagacttttgttgtaacaaacaactcttctcgaggtacattagtttttaagattgcttctcctacagcttcttcattaccataagactgtgctgtatcaattaaacgatacccagtttcaattgcctccaggacaacccttacacattcttctttatccttgatttggaaaactccaaatcctgccatgggcatttttacaccattatttaaagttatatattccattatttttccccctattctagccatatatttttagtctcaataatcttgttttaataatttgatttttaaattcaagattcaatcataatcttttacatttaaatatatttagtttatatactaaaaatctttatctgattaacagtgcactataaattatgcacttgtatcgataagaataaaaagttaaatatggttttttaaataattaaaatttccatctcaccttatttatctttaaacatagtataaatcttagagttaactataagtcaataaaaacttaatgttattaatttaaaatatcactaaataaaaaaagaggtctctttcaaacctcctatccaatcataaaactatttttaataaacaaatctataacccaactataaaatatattactcgactgcacatatacatttatttttattagtatttttagctttatataaggcttgatccgcctgctctaaaactgcttgccaactttcttctccatttaaaacacctattgccccaccaatacttacagttaaatattcacgacttgaagtatttggcattaataaatgcagacgttcaacagtatgacaaagttctgtaccaattctttgcatttcttctaaatctgtattttttaataaataaacaaattcttctccaccataacgaatcaaaaacccttcactcaaacataaatttaaagcattagaaactctctttagacattcatcacctttaatgtgcccaaaagtatcattataagatttaaaatcatcgatatcaattataaaaacacctgttttaagctgactatcgcgactctctaaataaatattatttaaacaattagctaaataacgtcgattttgaagccccgttaaagaatcatgatgggcaataaaatctaattccgcacttttttcttcaatcatcctatttttttctagaatgatactctgatttaaaaaagtttgtcgcattgattgataatgataatatccaacaaatagagccataatcgttaaccaggtactattaacataaatactataatgactccccaatggttcaccatgtttcactaattcaattccagtaatcaaaataatatcagagaacaaatacagaggaacaaataattttggcggtaaataaacaagaatagcaatactcaacattgtaataatatgcacactaatgttattagaaacacgattatcatatatcgttactgctagcgaccacatgattaaaaaaacaatatagtaattttgaactttcaacaataaaccctttttaacattctttttatgcaataaaatcaaccctaagacacagatgataaacatgagtgtgtataaaagcatataaatcttacttgacttggtataataggtaaaatccgtatatacacttacatagaccatattatagatttgaaataacataataaaaaatatcgggatcctaaaatacttcttaatatcatcttcgagaacatcaataaattcaagttcttgctgtttagttagctttatcttttcagttaatgacaacaacttcataatttgtcctttctaaatatctatttataattcttattgacgatgtaagaacaaaattggaaatggattcccttgttcatctaattcacttcgccgataaatagtaaaccccatatattcataaaaagctagagcttgaggattttgctcatttacacagacttcagtgatctcataatcatttattcctatctctaataaattcctaccaataccttgtcctcgacgttgtgctgtaataaataacatctctaatttatcctcagcaatccccataaaagccaatgtttctttattatcaacagcaactactaaaattggaatttcttcaattgcttgaaaaacatacttttttatttctcgaatattagtttcactaaaaaaatcatgagttgctctaatcgaactttcccaaaccgtaacaagtgaactaattaactgttcgtctcgttcaaatactctttttatttccattagctcctcctttattactcaaagaaatcctttaaataaatatactgcattataaattttttaaacatccatagcaactacacgtttaatatattttttcataatcttttcaattccaacatttgttaaaatgatttatcattatttctttcaatatataaatagttattatttactttattttactataatcacgtaaaaaagatagttatttaattaataactatctttttttcattaagttatcatttgtattttttgatttacctcttattaatataagtgcaataatatttgcagtcaacatcgtaattacatatattgtaagaattgtaaacattgacggtactacatccaataatgctgaccaatcttcatgctttacccaattacttactaattgataccctgctaaaagagtaagcacggtaaaaacaagtcctaaaatcgaaaaccaataagccctcagcttctcttgacttttaaatatagacagacagctcatcaaagtacagataatactcaagcttccaaagataatccacatactacattattctcctagatataaaatttaagattattttaaataagctcttgatcaataaactctatataatttttcttaacaacttcatctggatgatcaaggtaccactgatatgattcctctaatccttcgaaaagacttttttgacttggcaacagctgattttgcttagttacatcaagaacataattatagttatgaaaactaaaataatcacgttgattatcatgcttagttacatatactttatttagcggtactcctacaacttgataacataactcaacaaatttatttatatcaacaatttcgctatttccaacattcatgatatgatcatgagggtgctttttaataatggtttccattaacttgcatagatcttcaacatgaaaaaactgtaataacattttaccatcattaggtagatagaaagaacgtttctttaatgcacattcaaacacaaaaggttcgcgataaacattttgcattggtccatataaatatggtggccttaaaatatatgcttgaggaatatgacttagtaaatagttttcagcttcaattttattacttccataatctccccagatagaatttcttccaaccttctgctcctctttgaacggttgtgataaactttccggataaacagcactggaactaatcaaaatataatctttgaccccatttagaccttctaacaaatctttgacatcttgtttagtataagcagtaacatcaaaaaccacatcaaaatcatatccctttaacaaatttcccaaatgatgtcgatcacctttaattaattttactccttcaatctgttttcgatttccacgattcaaaacataaacatcataatcatgatttttaaaataagttgcaacaaatttacttacaaaaactgttcctccagttaccaaaatcttttttgtcatattctctccttactttataatgatttagcacatgcaattaaataatgacgagcattagcagatgtcacttgtttagcccgcatcaataaggcttgttttttcagttctataatttgtaatgaattatcttgcaccatcaataactcaattaattgcaatgccatttgataatcttcttgtgccatataatttttaatagctaatattagtttatcattatcaccaattaaagcaagtaccgcctgattataagcctcagttggatgtggcaataacttcacaggatccccatcaaaccatcctacataaccattataaatacttttcactgaccattctacagtaccataatactcacctaaatattctttatcctgatatattggtgctaatttaacatttttaacagtttcttccaaagacattccctgattcatacaatctaatgttttaaataaaatatcctcgatggcatccctaaaagttcccactattgctttaatctcattttgccataaaactcgtgtatgtcctggtaataatgcaacagctggataatttaaaatctcatttaaagtatcaatccatgtcgcaacatcgcgatacatggttcctcttattgcataaagattaggccagcatccataataattatctccacaacacattatctgatcatcttctaaccaaacatagatttcatcatctgcttcacctacagcactaaccatctttaatttaattccatcaattactcgttcaaccactttttgctcataatatgtcgtcggttttataaaatcatattttccttctttaatttcttttccttcacggattccaattccttgactaatcgcttcctgatctgttaatccataaccatgctgataaatccctcgttgatttagtagtttactaattctatcgtagtattttaaaattggttttcgaggtttaaatgctattacttctacaactgtatcccgaaaagtacctgctcctcctaaatgatcaggatgtccatgagtataaataattgttttaaccggtttatcactaattttcgctagttcatctttcatcacttttgcacgataatcagaatcaagagtatcaattaatataattgaagtttccccaataatcgcaattgcattactatgtccatagcccaaaaaatgatatacccgttcattaactttagtaattttcttttgatagtttgttttcgtaaaattaattaacttttcttcacctaacattgcttattcctccttatatatcattatattgattatctagtcttttaatagtaggcacctttaggtaactgtcaaaaccgtagtcatttggactacggttttatttaatcatctaaaataaatgactttacttgattcttttttagtttattattagtcttaactatctcttcttttaaatcaacaaaatctttaagatcatgatttaaagaaattaaaacctctttattattagtattaaaagttcgataaattaatttatttgaagattctgccttttttaaaacacttagtgtagtaagttcattattttcatgaagcagagagaaagtatatggagtgttaaaatcaacctcatttaacttcatcgcattgtacggcattttattataactaattaatggcgttaaataatctttagctaaacgtgataatttagcgtgatcattttcaataacaagcgcaaatctaaactctaatggttttaataattgtgaatctggtgtaggcatcttaattcctgatggtcgtcccggacgccgaactaattcttctttacctaaatagccaactgatcgaaataacgtaattgccagggtattataattatccccaattacttcatattctctaactgaattagtgagtaaagctaatggacaacccttgattgcaacgtaactaagcattggataaatactatctggccgctcgctccaattatcttcttgccatgattctatcgccatatcttttactgggcgttcaattatcccaaactgattatcactaactgaggcctgagcccaaatatcagttggaagaagtactctaagtcgatgatctttagctgtattatcaatattagttgtaatgtcaagatttcgttccccttgttttaattctatttgaaattcaatttttaaacttgtatcacatttcttttgtttacgacttgttaaatcttttggtactttcatttcgacaattatatgagctgtagtagaatacctggatctattgatttgataatctgccttagcatctttagaagttatgatataatcttccaataatggtgaataatcataaccatcaccctcatcactaccatcttcaatcaataaaacggaatcataagtatgatcattaactaaatcatatatttttaaagttccattactattaattttaatctgatagtattcattttccagaaagtccactttatctaataaaatttcttttggctctactgcttcttgaattaaataagcctgataccccatcgcaggaaaattatctttaaattcaattgtatattttataaatggatcataattcccataatgaacaatctgacgatcaattaacccagcatcaatgatttctttattaataacttgataatctatttcatgaccctcactagtaacaattttaaaacttttcattctcgtgataacttcactgcgaaccactcgatttcttggataagggagtaaattaaagaccgttagtttatcaagcgcaatatctttaggcattgcatcagtaatctttcgtttataaaagtcaatcattcgctctactttctcattagcaatcgtaaaacggctgcttatttcttgatgtactttatcactacaacaacatccaattgaatcatgggcatgatttttcattatctctttccatatcgattccatcatcccatcaaaatactcaaaccctaatttaaaagcaatggaagccaatggctctagcagattggtaattttattttcaattacggtattcattgttttgatatctgcccgtgatgaaaaaatcgaacgatgtacacgcatatatttaccatccagcagttcaccatgaaggatatcatagttatcttttttctctaattctttaaatatctgatcatagttacttaaaaagaagtttttatctggataaagtctttttaactgctcaatgacatcaaatatatttttttgtaatggcatttggtcgtgaccattaggaattaatatatgttcactagttgctcctttttgtaacactggcatatatttatcacaacgtttttttaattcatcaagatctgtgggtaaatattttccaattgcataaccaagtggtaatagttgagttaagacttttgaaccatcgtcactagtccaataaaactctgtcttatttgaacccattcgctcactcgttccccgccagaatatgcttcttgtaattccaaaaccgtttaaaatcattggcatttggcctgactgaccaaatgaatctggtaaataaccaatattcataggttctccaaaagtctgactatctttatgaccgtataataaattacgaacaatcgactctccacctacaaccatctcatcagtttgagtgtaccaaggcccaataattaatttaccttttttcactaaattaactattcgtgataaattttttggttttaatgctagataatcctcaagtacagctgtttgtccatcgagaacataataaggataatcctcattattttctaacatttctaatatttcttccatattgtttagtaataataactttgattcttcggctgaaaaataccactcacgatcccaatgcatatgggggacaatgtgtacttgatttgccatgctattcctcctattttgccttagctaatttctgttttcgagtaattacaagtagcaccgctgaaataatcgctccaattactgccgctccaaaccagacgatcatcgctaatggaatattatcagcagttaatacgaaaatagagaatattcctgccccaggtacatcaagaccaatattaaacatcgctacaatcgctccacaaactgcagaaccagtacatagggatataattacacgaattggatctgccatcataaacggaattgccccttctgtgattcctgctaaacctaatagccaggttgaatttcctacttcacgttcttctggtgtaaataaatcttttctaaactttgtcgcaaatgtcaccccaaatgcactaaccattttaattgaagcaaaagcacaatatggcattaaaactccttccgccattgcagcaacacagaaagcatatgcagctttatttactggtccacctaaatcaaaagaaaccatgattcctaaaacagcccctagtaaagcagcatttgttcctgccattgatcctaaaaagtcaactaatgctgtattgatcattgcaactggtttacctaatacgactaacaataagactccaacaatcaaacaagacaatacaggataaattacaaaactcacaaaaccggcaaatgttcctttagctggaatccatttctttaaatagcgtattgaatacccagcaatgatcccaccaagcatcccgagtaagaatccaccgccaacggtattagcacaaaatccagccgcaaaccctgaagctaaagctggtttatccccgattgaataagccatataagctgataataccggtaccatcaaggttcctaacaatccacttcccattgatttgatcaaataaagccaacttccttcggtattcatcaaatctgtaaaaccaaaggttcttgcaaagattacacaaattgctgcaatcattccgccagccacgatcaatggaataacatgactaattcctgtcataaccgcttccttaactgtttctaaaaatccggcttcttgatgtcgtgaatgttctacatactcaccacgagcagtttgttctgctttaactaacgctgtttcgataatctttttagcatcctttaatggtgcagatacttttgttttaatcgttggtaaatgactaaaacgttcctcctctttaaccgctacatcgacagcaaaaatagctgcacttgcattttttaacatctcattagtatgacgatcttcaattccattagccccctgcttttctacatatacatttactcccaactcttgcccagcttttgttaatgcttctgctgccatgtaagtatgggcaataccagcggcacacgcagtaaccgcaacgattgagcgatcaaaggattttatttcatcactattaaccccattatccagattttgataaaattcttttactgttttagaagcatataatttttctgtatatgtatgattagccatcttcgtcatcatttctgctaataattgcatttgaaccgaattcttatcattttggggaattgcaagtaaaaaaacatattgtactttgttaccttcaacaacactttcccaatccttcacaggtttctttaaagttacaaccgcaaaagctgcttctctaactactccatcttttccatgaggaatggccagaccattatcaatccctgttggtgttaagctttcacgttctaatactgcttgataaaaatcttcctcattactaatttttcctgcctgatataatttagaaactaagaatttaattatttcatcttttgatgacaaatcactatttaaagtaataagctgctcacttgttaatttagataattccatttcttctgccctcttcttttaattttattaatcactgacatgtctttccctgattacaaaaatatcatagcatattattttgtaacccttttcaatttggaaaatcatacacttatttttaaataaaaaatggatgtaccgtgtatttatacacagtacatcctccaaaatacctctgtcaactctcgaagcagcatcatcatccctgttcgatccgcaacattatagccattcaatttttgttcatcaccccaataatataatggaatatgtgctaaaccagccaatcgattttcattaaaatgggtaaccgaaataacaaaaattccattctgttttgcttcttctacccaattattcaaacgaccattctcaccacttgcactaattacaaacaaaatatctttttcttcacaatgcttgattcgatattcaatttcacgataagtttgataatattcagctcgataatcataacatcgcaaattatcgaccatcatttcacaaaaatataatgactcaccgacaccaataaagtgacatgttcgggcattcttgatcttagcggcaacttcttctaacgttttataattaattagttccattgatttatacaaattctttgataataatttttgaatatctaaattttctgatacttcgttattaactaaaaatttcatctctgcaaagcctttataccctaactttttacaaagacgcatgattgagttgggaacaagataaagatcttcggctaccttttgaattgataaatgttccaaatttgctttatttttacgaatataatcaacaattagatcatctgtatcgtttagtgtaaactcttgttgtaagacccgttcttcaaatttcattatattatcctccatgacaagataaatatcaactctctcaatataacttatattctaacattattttttgatttcggtgcataatctttcaattctggaattgctcccgcagcaactgcccataaatacaaactggcaattgttgcatatggtccatagcgacgtttatatttagtgaatagttgaggtgtaattcgccgatgatgatagaccatgcgcattccccgtaaaattgctaaatcgctataactaattatatctttacgttgtaatgaaaatgttaaaatcatctctgctgtccatctcccgattccaggtaactcacaaagctgttctataacctcttcatttgatagatcagctaatcgctccaaatccaattgatcactaatgatccgtctcgttatttctttgatataatgtgcttttttcatcgtaatgccacatttttgtaattcctcagctgaaagtgatttaaaatttgctggggtaatcggactaaaagaattgttgattctctgccaaattgtttgatgggctttagtagaaatttgttgaccaacaatcgaattaattaaagctgcaaataaatcaggtattaccgcacgtttaattataccaatctgctcgattacttgttttaaaacaggatccctacttttcaaatattcaatttcaatatcgctatattcaaaatattccattatatactccaacctataatcttatcgcatagttacaataccatcattttaaaacaatcaaataacttttttgactatattgattagctttattaatttcaagtatacttgaagtactaaactttgtaaataaatgaaatattatataaatcaagtatgtttccttatgtaatcaaatagtttatattactgcttttatccttatgattataaattgttagttcataattatctaataaagcacaacgataaaaatactctagtaagtttttactggagtatttcatttatactttaaataactcaataatgtcattagtagacattgttgttatactaccttcattattttccacaaaactatcagctaagtttttctttttattttgcagttctaagatcttttcttcaacactatccttcattaccaatttataaaccgttacaacattttcttgcccgattcgataagcacgatcagtcgcctgattttgtgctgacatattccaccaaggatcaaaatgaataactgcttcagcagcagtcaaattcaatcctgttcccccagcttttaatgaaatcaaaaatactgttgtatcatcattttgaaattgattaactaatcgatgacgttcttctttttttgtatcacctgttaattgataataagtaatactttctttctccaattctttagcaattaaatcaagcacggaagtaaaagaagaaaataatagcactttttgattatttcccaggaaatttcggattaaatcaagacatcccgataattttgatgaaatattcgaaatattatcatatattatccgtggttcacaacaaatttgtcttaatcttgtcaacattgctaaaatagcaatacgatctacattatcataattaagctgttcttgcagttctttattgacctgaattaaattagctaaatacaacttattttcttcttcattaaattcaattgataatgttttttcaatcttctccggtaattcagtcaatacatcttttttattacgtcttaagataaatggtgtaattaatttttttagttcctgctgtttgttttcatcatgatttttaacaatcggtgtttcataattagttttgaaataatgatagctatacaaatactctggcattaaaaaatcaaaaattgaccataactccgccaaagaattttctataggagttccggttaaagcaaaacgatgtttagcttttaacgattttactgttatcgcattcttagttttaggatttttaatatattgcgcttcatccaaaataatattttcaaattgataaccatcataaagattagcatcacgacgcatataatcataagtagtaattagcacatcaacctcattaaattttctaattgcttcttttcgtcgttttagactgccgtgaatacaagtacaagataaagaattagaaaatttatgtatctcatcttgccaattcaatagcaatgatgatggacaaacaactaaactagtttttttatcatcccgattttgatccagtaaaacaatcatttgtaaggttttaccaagccccatatcatcggccaaaattcctccaaagccataagaactaattgattgaagccattgatatccaaatttctgataatcgcgtaaaatttcttgataattaggcgttaagggataactctgtttagctatatctttaaaattatcaataatttctttaaatacggtactacgatcatatactaaataattgcttgtttcggctttattatcaagactaaaagcccgatagacatccatttctaaatgtccatcctcaagcatctttggtctaatttgataatcagtcataaattcatttaattcttccagctcatcagaatcaagatataatagttgaccattttttaaccgatgaaatttcttcttcttttgatatgagtttaagactaacgctaattcatctttaggaatatcaatactttcaatgtcaattgccaataagtcattttctaaagtcactcctacattaatactaaattgacttttcttcccaatctttttaagtgcatcactaaccatcacttcacaataattagctaaaaaaggcaaaccttcatttaaaaaggagtaagttttttcactttctaaattcaaatacatacaatgtttttcaaaatcaactacatcaccaatctcttttaaataatcttcaattaaatcaaaattaattgatgtttgctttctcgactgttgaaatgaataaatcgtttctaggccttgtttactttcaagataaactttgatttgttccaattcattaatatcgccatagagtgtcaatatttctgtttcgacaacttcacttgttaataagtccccagtataattaaaatattgcttaatatcatttaaaatatatttaacaaagtcatttacatcttcttttgctaataataatttgtctttactttcgcaattatgaataaatttgattgcttttccttcatcatccagcttaaccatacctatttcattttcagtaatcttataaagatttttataaccacaaaattcatcaaaatcctttaattcaagcgaataatatttttcaagtttccttatatgtaaagtaggctgataattgtattgataaattgataaatgttgattagttttttctaaatcttttaatacttcatagatatattcaatactttcgggaataatctttatctcatttgtcacatgcgatatatcgtaataatattcctgttgataccgctcataagtgatcatacaaaatttcattaattcaataatcttcagtgcttcatcactaaatactttttgattatgaacaaacgctaattgtttaccatattcaacatattcattatttgctaatgcacttaaaaaattaggaatattttttattatatactttttatcacttcctactttgaattttaaacatgggtgcccataattaatcttgatctggacttcaagatcatacttttgatttagtttaacctgattaaaatcaattgctttagcagtcttaaatgatgctattaggttttttgttactgctaattcattttttagcagttcttcttcctgctgctgacgaatttgtactaacttgtcgaaataacttatcttaccatttttacttttatatttaaatggaaaatcatcaggtgataactcttgaaccttcagcaaaacagccccaatatgaccgcaagccgagagttcatcacaccaataacaattacaactatagtcagtaatcttattatcttgatcaataacgattttacacacattttcataactaccattatcaacaatgccttcaattgtataatcatcaaaaagtcgatcataagtaattgtgatttctctaacataatctttttgataatatattcgtcctgttcttagatttctaacactgcttacgattctatgtaattctttgtcagttacaagcacttaccagtcacctcctaattttctttaaaattatagcatatatcgaataatattcattaatattacgactctaaccattatgactaaactaaatacatagagttataaagatgtaatcttgcagcaagtatttatttcaataaatttcttattactgccataatcaaatttttaaataattaaatactcatttccacaagcattaataaacaataacaaatcatcataggtaattgatattgttgctgtattaatattagggtgaattaataatcgttgtgctcttaattcacgatcaatcaatatttttactcgcttattatcattaattattcctaatggtgtcactgatcctggaattagctttaacaattctacaagttcttcatcactagcaaagcttagccgcttactaccaatttgtttagctatatatttcaagtcagcacgcctttcaaccgtcatcatataaatgaagaattgtttatcactactttttaaaaatagatttttacatgctactccatcaatttgctcattaataaacattgcttcttcaacagtgctaactgattggtgattaattttttgataatcaatacctaactgtgttaaaaatttatatatatccattgttaactcctctttttatgataatgattttaacatattaaaagtttaattgaaaataataaaagcatccaaaggatgcttaatcaattttctttaattcataatcaaaaccatattttaaaatatattcttctagagtccaattattatcataaattattttagctgctttcttaccaacataacgtaaatgccatggctcattagcagttccagtaatatccgaacgatttttaggataacgaagaataaagccatatttataagcatttttagcaacccatttatactcatccgtatcaccaaaaaccattctctttttatcaattacactttggctagttaaatctactcctaaccctaattgatgttcacttgagccaggtttcgcaactaaaccactagcagtgacttcatcataacggttaaaataatcattataaatttctacttgttcatcatatgagcgatatccactatttaaaactaaatgataatcttcttttaaagcatctttattcatatcttctaatgctttagctgcatcttttcgaagtttattatggttattatcaggagcaattggtatatcaggtacaacaagatcagcagggacataatctttaggtaacacaaaaccctttttaatcaacagaagtgtattactaggatctaaaacttcatattctgatccaacagcattattagcatcaataaatgggtaagtaaccgtaagtacagctgttattggctcttgattacttgcaagatacttaggcagatcctcaaagaccattccattaatctttaaataagatttaatttgcgaatatgtatatttattatcgacgattaccttaaaatcagacagctctgcaactttcattaaagataatacttgtttataactatattttaaatccttgagatcttgataataatcctgatagaaagtatcaatatattttattacttctttttttgaataatcttgatgttctttttgatatgtctgatactctaaataatgttttttatttttatattcattccaggaacttaaatcactgaccttttccgcatccaaataacgctcaatctcattatcatttagctgtaaaataatgctttgttcagaccaaccatagcccttcgtcattaaccgaattcttgtaaaattaaatgcaatcaatgtcccaagtattaacatagcgattaatacactaatgattactttataagggatttttttcttttcattgtacgacatgtaactgcttcttttcaacctattatcctcctcgatatattcttggcagtcgacttcctaaacgactcaaaatctcattactaattgtattagcttcaagtgcaatttcttctaccctaatttcttctgtaccatcttgaccaattacggtgactagatcattatcactgatatcactaatctcgctaacatctacaagcatttgatccatacaaattcttccaactattggacacttttgacctttgatcaaaacacttccatttgaagaaagtatacgtggcaatccatcaccatagccaattggaataacggcaattacactatcacgattaaccttataagtcaagccataaccaagactcgcgcctttagtcaaataatgcagcattgcaatttgtgctttaattgttaaagctggttttaaatctaattgtacttttgaataatcattgaacgttgagtacactccatacattaaaatcccaacccgagcataatcggcattgatttcaggataatttactaatccataactactttgaagatgaacctttcctatatcataatgtcttaattttaattcattaattaaatcataaaaagcagctatttgtttttgggtgtattcttgatcaactttccttttactatcacaaacacaaagatgtgtaaaataaccctgaatatgaataaactggtaatcatatatttctttaatactctcataatcgcttaaatcaaaacctaaacgatgcattccagtatcaatcttaatatgaacattgatcatatgcccactttcatttaattgccgagcatgctcacgatttacaatggtttgaatcaaacgataattatgtaattcaattgcacgaatgggatgactataaccaagtactaaaatttcgccatatatcccatgttctcgaagtttgataccttcatcgatagtagcaactgcaaaagcttcaattcccattttttgacaatgtttcgcaacttctactaacccatgaccatatccttctgctttaacaactaccattaatgaactatttttatttaataatgaactcaattcatcaagattatgcgtgattgcatctagatcaacttcgatccaactgcgacttgtgcgaatattcaccatacttctcttttcctttcaataaaatctctgaaaataaaacagttattatcaatacactaataaactgaatcagcgggtcaacaactaaatgatcacacttcaataatttacctattccacgaacaacaacaatcatcaagggatgaaaaagataaatagctaacgatagatctttacatttagatattcgtttgcctgatattcgtaaaagtccctgatatagccaaaacattactaccggcaataagatattcattgaatcatgacgtacaaaaacataatctgctgcatcttgataacctttcaacagtgatatttctataaacatcaaacttattgctaatatcgtgctaataacgattactcttaaactaaagttaaattgctttaccgcaagaagttttccaatccaaatgaataacggtgcaaagaaaataccatttcgtgtataatcacttattaaaaaaatcaagtcatacccccatttacaatatgggtgtatcaaaccataatacgaatcaccacctaatccaattaaataaagtagtaccacaattgaaaaactcgttaataaagatacccgtttatctaatactgcaacagtgatcaatcctagaactgttgctggtaaataccacaaatgatagaaagttccatcgaacaaaacatctttaattatttcataaatcagattactttgattaaaataatgattataaagatttaatggtaaataaataattattgctgctaaataaatcaatagtgtctgtttaataatcttatatagtcgttttttactgggattaagaaaatagaaataagcagttgtgataaaaaagaatggtactgcaatacgtcctaatccacgagttaaataaaaatctaaagttgggctaattgtatctaatggtgaagtatgaatcgtgacaactaaaattgcagcaattatcctaaaacagtcgattaagggataaccttttactttagacatatggcctccatgatgtaataataaaaccatcacaattatttcccgatatttgataactaccatgatcacttaagtttaacttagtctgttcattaactgctggaacataaaatacttcaactaactttccttggcagtctaaaacatatggattgaaaatagaatgattttttatatataaatgatattcttcaaaacaccactgattttcttccataatttttgcatgaacaatcccaacatagcgaaaatgccatggttcctcactaattttggtaaaatcaattttatttttagaatatctctgaataaagccataatcacttgcaatatcacgaaattgttgacagatttcctgacttgtaaaatcaggacaaaagatatcaattgtttcattttttactgctaaatcaatggctagacctgtttgatgctcactacagttcactctagcaacaaacttatcaacaaactcttttccatgattttgaatagcctgattatagatcatagcttgttcttgaccgcttcttaaaccactgactaaaacaatcttatcttctgctttaatttcctgtaatgcttttgttagcatctccatagccgttttttctaatgatattgttgaatccttggcagtcgaacagttagtaatttgatagttatttgcaattggataattatgattaaccaatactaatggaccttggtaaatatcatctttatttaaagttaccatctgcatacttaagccctatcgcaacaattttatctattaattcactaaattcaaaacctactcctttcatcatctggggaaaacggctatgatcagtaaaaccaggaatcgtattaacctcattaaaaactatttcattgtttggcgttaaaaacatgtctaccctagcaaaattctgacaagctaatgtctgataaataatttttgcagtttcttgaattttccttgccgttacttcatcaattctagcgggcatatgaattgttgaagttttcaaagtatacttttcatcataatcaaaaaaacctcccgataattctatttcatctacctcaccaacagtcaattcatcgttgccaataatcgcacaacctacctcaaacccttcaacagcttcctctacaattacttcattatcgtaattaaaggcatattcaagtgcttttgttaattcttccattttgacaactttactaattccatatgatgatccagcttttaatggtttaacaaataatggaaaattcaatgctttaacattaaaatcatttatattatgtacaagcacagacctagtaacctttatccctgctgctttgactaactggtgagctcgatatttatccatacataatgctgatgctaataatccgcagccaagtactggtatttttgcaagctccattaatccttgaacagtaccatcctcaccattttttccatgcaagaccggtaaaaccgcatcaatttgctgatagattattttattatcaactatttccatcactgcttgtctttctggttctaaacataccgtcactggattaagcagttcttgattccaagtatcattactaattttttcaatttccccatcataatgaaaccactgtcctgctctcgtaatcccgattaaataaagatcatatttttcttgcggaaaattctttataatcgcagctgctgattgtagcgacacttcatattcacttgattttcctccaaataaaatagctattgtttttcttttcatattatatccttccttactactccttcgataaatctataatataaaaaaaacgctcttcattttttaatttcttcataagaaaaaatcacaaaattcccacttatttcttacatttttcttacaaaaaaatcagcattctgctgactttactgttaaatattaaaatgctttttaaaactttgagcaatcccatcattatcaacactatcagttatttcacttgctacactttttaatttaggaatagcattccccatagcaataccatgtttaaccaattgtaacatctctacatcgttgataccgtcaccaaaagcatacgtgttttcataatcaattcctaatttttgatataaatattcacaagcagttcccttagtgaaccctttgcaataaacatccattcgaatcaaacctgtatcatacggaatcatcgtaaattcatcttctaattcatgataagctgcccacaactgtgctgcactatcaaataaaacacaacagcttaccgctttaacatcactagttttaaatacctcattaacatcagttggtctttcagttgttccctgaaacatagcacgatgttttataaccaattcatcatcaagaaaactgcaccatgcaccaccgcgaccattaaacattgaacgaccattatattttgcatatacatctaattgcttctgcaccattccattatcaaattgttcatcaatcaaaatctcattattaaaacgaatataatgtccatcattacaaatatacccatcaaattcaatgtttgccacactttcaggtacttcaccccgagctgttgcaatgacgatcttattaccttgatttttaaattcatttaaaacccttattgtctcatcagttggatgtaacatcccattaggtacattaactaatgtcccatcaatatcaaaaaacgctattttcgtattcataatgctcctccttcttttaagtataaagaaattcatatcttttatgagatattttaatattatgaaaataattactgaatcacataatcttttgcatgatcactgtaataaagagcattgtttgtatcaataaacacggcttctatccccgctaattgatttactaatgctaacccctgctctttacctaaagtaaaacatactgtgcttaatgcatcaccatcaactgaatgattactaataatcgtaactgaagctaacccattatcataactatatcccgtcttcggatttaagatatgatgataatacttcccttcaacttcaaaataacgttgataaattcctgaagttacaaccgactgatcattaatttttaattttaaaatatcactacttcctttaggatcagtaataccaattgtaaaatcatcactattctttttccctacacaaagaacattaccacctaaattgataattgcactgtctactccctgctcaattaagtattccttaattttatcagcaatatatccctttgcaacagcccctagatctattatagtattaggattactaaaactaattgtactatcatttaaagtaattcccctatatccaatcgacgtcaaagcaccggctattgctgaagtttccggcaattttggagtatcagctttaaaatcccacaaatcaatcaattgtcctactgtaatatcaaaagtaccattagataacttactatattccaaaccaatatttataactttagcaagttccttggatattttaattagtttagttttatcttgatgattgagctgatataattcacttttgggattagtccgggaaaagagaagctcgtagtccttgcaaatagcaaaacattcatctagaatattagacgaagcacgatcatataaagtaatcgtaacttgcgtatctaaaagaagctgcgtttgacttagaggctgtttattcgtacatccacaaaatataattaagattattaaaatttttataaaccaacgttttttcatgtcatttcctttcattctggaggtagctatgtttaagaagaaagacttcattattattttcataatttttgtcgttattatcggggcactgctttttaatcatttttatttcagtcaaaaagctgcttacgtgaaaatcaccgttaataatcaagtatatcgtactgttcctctagagattgatcagacaattaagattagtgataaaaatatgatcgtgatcaatcacggaagtgtacatatgaaagatgctacttgccctgataaattatgtatcaaacaaggaacgatatctaaaaatggtgaacaaattatttgtttgcctaatcaagttgttattgcaattgtttctaatcaatataacgatgttgattcatcatccaaataggaggccccaatgactaaaagaattacctatttatctttactaatcgcaatcgcaattattctcggttatcttgaaacctttattcctattaactttggaattcctggtgcaaaactcggccttgctaacctcatcggattaattgcactatatcgctttggatttagagacgctttaatcatcactctcctgcgagtttttattattgccagtgtttttactaactactatatgtttttatatagtttaagcggtgctttattaagtttagtcattatggttcttttaaaaaaaaccaaactcttttcaactttgatcattagtatttccggcgcaatctttcataatctaggacaaatcctagtagccttaattttctatggttttaatattatttattatctaccttatttaataatcttatcacttattacaggtagtgtcattggtatcttaggccaaattattttagccaaactacctaaacaactatcataatgaattgttttttactaaaaaaaggaatttcttccttttcaaacaacaatataactctcatttttagcagcaaatgaaatgatcatgtaatattttatattgggagagaaaaataatctacatgatcacttactttgctacgatagtactatactccttaaacattactttaagtcaatctttttttattaaactaattgccgattcatccattttccactaaaatagcgccagataaagaaaatacaacgaactccccaatcaataaacattgcaatccaaacaccaattaatccaagattcatatattgtcccaaaacataactaaagcataatctaaatattagcattgatgcagctgaaactatcatcgtaaacttagcatcatttgctgctcttaaagcatttggaaatgtgaatgacgtaggccagattaatgctgcaataattgcatgtaaaaagatacattggtatgcaaggtccgtcgtttcttttgataatgaatagaatgttaaaattgaaggtgttgcaataattaaaactacaattaatccagccattgaaagataagtaatttttaataactttttaacataatattttgcttgtttataatcatttgcacctacacattgacctacaaccgtcaccatcgccaaagacattgccatcccaggaataatctgcatttgagccaagttattcgaaacagcattagctgcaattgaatatgtcccaaaagttgcaattaaactttgtactaagattttccctagctgaaacatcccattttctaatcccgaaggtatcccaattgctaaaatcttttttatatacataaagtcaaatttccaatgaagataatcatttacacatacatcattatcccgatgacttaacatctttaaaattacgatacaagctactgctctggcaatcagcgttgctaatacggcaccaaataccccccatctaaaaacgaaaataaaaattgcatttaaaataatattaataacattcatgactgcactattaatcatcgatattttagagttaccaattgccctaaataatgctgctccagagttatataatgcaataaaaggatacgacattgctgaaaataaaaaatagatttctgcatttttcattacatctacttcaacatttccaaaaaccatgtgtaataatggcacattaaatgcaataactatcaccatgataattactgacaataatgctgtaatcaaaatcaactgttttgctgaatactttgccttatctttagaaccctgtccaataaactgggctgcaactactgctccccctgttcctaatgcagcaaaaatattgattaataaaatattaattgcatcaaccagcgaaactgctgatactgctgcttcgccgacgctagcaaccataacagtatctgcaaaacctacagtaattactaataattgttccacaaccaagggaataattaatttttttaatgctttgttatcaaataacattcctcacgccccctacagttacctattatacgcccatattcttttgaacaaagtaaatttcattttctggaaaagcaaaaaaacctcacaaatgaggtctaaaaacaaattattagtctaacaatgcttaaacaaagttatcaattctgttgaggtcaagtctcgatattcccctaaagctaatttttgatcaagttctatacctgcaaaagcaattcgtttaagtgtacacacttcattttgacatgatttaaacatttttttaatttgatgatacctcccctcattgatagttactaaacaatggtattcatcaagtatttccaataaactaggtaaacattgaaccttgtgatcaatcactacaccatcaaagaattttttaatcaattcatctttaagcggaaatttagtagtcacataatattttttattaacatgattttgtggtaataataatttttttgatagtgaagtgtcattagtaattatcaatagccctgttgtatcaatatctaaacgccctaaacaatagcaatcttctcgcccaatcagatcaattacacactgatgatatttatcatgatttgcacaaagatagtcagccggtttattcatcatataataaacaaatggctgggcatttaattgaatatgatgatacataataatatcatccgcctttactggataacgaacatctgtaattacttgatcgttcaccctaatttccccatgcctaatcaaggttttacatatcttgtgattccctagtttattcttcattaaaacataatatagatctttaattcgactcacctccattttagaacttctttagcaaactttttagctgcctggatatcctttttatcaggatgtccaaagtttttaaaaataaaagcacttcctttacatgaaaacaccggtccataaattattcccttttctttaagctgtgctttaacattagtaaattgatctgttccaaaaccgttagcagaaaataaaataaccttcttaactttattagcatcaagttgtgctacaaacctagttacttgttcaggaatatttcctcctaaaattggacatcctaaaaataaaatatctgctttaacatcttgcacttgtttaatatttttagcatcgacttgaagttcgtcagcaattgccttcgcaattttcttattattctttttacttttatatattacttcaatcatccttctgcccccttttgacgatttttaaaaaatacttctaaatgatcgatcccatgcattaatttaattgataactgataatactgagtgatttcttcattactaaattcactaaataaagcttgatgtacctcatctgttaattcttccatatcttttctaaagcgcaatccctgtttactcattaccacacataacgaacgtgcatctttgggtgacttctctaaaatcacatatccctgcttttccaaactcagtgctaatttttttacattttgtcgtgaacaccccatcacttttgctaacatgcttaaatcaggagcatcagtaaatgaagtcatcgtagccattaataaccattgtttactcgtcatttcattgtaacgatcaaatatcgcatgtaacttattctcctgaataaacacacccgcaaataacagttttttgacccatttaggatcctgtcctaataattcataacttgattttttcatcattctctccatatccgtaactagttacttatttttattatagtaactagttaccaatctgtcaataaacaaatactttcatcagattatttcataataaaaagttataatgacttctcactataacctctaaaacagatattttaattttcgattgatcttattactttacagggatttccacaagcaacactattaggagcaatatctttagtcacaacactgcctgctccaattacacagccatcgccaatcgttacccctggtaaaataactacattaccacctaaccacacattattaccaattttaattggtagcgcttgttctaaaccagtatttctaattttatattcggtaggatgaatagcagtatatagaccacatgaaggtcctatataaacattatctcctaattcaattccaccaccatccataaaataacaattactattaataaaagcatttttaccaattttaatcttatttccataatcacacataaagggacttataagctctatgtttataggttgataacctaacaaacttgtaatcacttctaatcttttttcataactgctaggttttatgtgatctagatcaaaacacaaatctttagctaatactctttgttttaataattcttcatcattatttgcatcataccacattcctaattccattttttcacgttctgtcatttttatttcccctttattccttcttttaaccatttcatactaatctctgcactaggataccctgcaattaaaattgcctgtgcatgtacaccataatcacctgtttgtaccactgctttacaacgatcacgcatttcataatattcaggaatgtaatgcatcgaatgaatatttttctttcccaacaaatcaaccagtaactgataatctttttgatttacttcaatcatatcttctgtgacgattgctccttcaaaatcaccacaagcaactagtgtagttactatatcctcaaaacttggtgaaccggtcactacttctacatctatatattcaacacttgaatccagtgggtatagggctttactagatgttccactgccagcatcagcaataaataacatctcaccatgacgcagactagcaacaactgctgccaaacgttcatgaagaattctcttttttggtttcacacttatctccttatttattaaaagtcttttattaattaataattataagttatctaataaaaaagtcaacaaataaaacaactgtccttgaaccgtcctaatcaaataaatagatgaaacaatcaaattattagatttgaagttatcaaaaataataacttcatttattatttagaaataaacaggttaagctatgcaaatattattactatagtgttcagtctcatatttcataatctttttattttctggtattgaacatcaaactgataaatctgatgataatactgttcgtccaacaaacatataaatccatatttctctttcaattcaaggaaagatttatgattatttagatgttctttgacaatttctaatttatacgctttagcatacttttgtcccctcaacaatataaaagttcctattcagtgtttaattatttacactatctaggaggtttttatatcaataacagttgttttatttgtcttgtttaatgaaactttctctaataacttcctgtattcccaataaataatcattttcataattagcacaatacgttaattcaggcataaattcacttggtaaatactctaaacaaatcttcttgatttttaatatatcatcagcctcaatagcttcacctgttaaaatcacgattgaaggatttattatcgatgctacacaacataatgataaagccacatcttctggtgaataatcaaagcataactgttcttgttttaggtatttaaaaaatggtaaatataagatttcaccagcaatactattttctccttctattaatttaccattaataacactcccacagccaggtccagaatttaatggaaacgtcacataacaaagatcctttttattattatgtaaatagcagccataagcagtataattcatatcatttttaacaactgtctttaatcctgtagccttctcgatttcagctttaagatttacattttttaaattaggaatatctgattcaattactatctctttagaaattattgccggtacccctaaaccaattatttggattctcgaatcttgtgataaaagatatttaatgaattttaaaatatcctctaattttaaatcatttactaattctttaccctgttttagtacacttgcaagggcatcaatgatttgccagcaaagataatctctgcctctttttctttgtacaaataaacacaatgaatgaaaatattctggattcaatccatattttttagtaggacgacctttttttaaataaataatttctttttcaacaacagttccattatccaaaaaatcattaagaatcgttcctactgtagctactgtcaatcttgaataattagctagttctttttttgtcacttcttgatgtcttaataacaatttcaaaatgatttgatcatttaaatctcgtagttttccagttccaattctattcacatttatcagcccttttcaattatttttgattatatcagtatttttaaaagaaaaataccctttgtctccaaagggcttttaattcaagtacgtcattaacacattcattattatatgataaaaatgtcttttgggcaactgacaaaaagagaatatttaatttttttatttttatattgacttatagttaactctaagttctatactataaatgtagaaaagataaatacatgaaggaggacttaaaatgaaaacatggttaattacaggatgctctagcggaattggacgcggcattgctaaagcggtattaaagaaaggggataatgctgttgttactgctcgtgatacaagtaaaattgccgatctagtcgatcaatatccaaatacagctttaggagtggctctagatattaccaaaaaagagagtattagtgctgcagtaaaacaagcacaagaaagatttggaacaattgatgtattgatcaataatgctggatatggatatcgttcttcagttgaagaaggtgacatagatgatgttaatcttttatttaatactaacttctttgggccaatcgaactaattaaagaagtattaccacaaatgcgagctaacaaaaacggtgctattgtcaacgtatcatcaattgcagcggttagatcgggtgtaggttctggttattatgctgctagtaaggctgctttagaattaatgactgatggtctagctaaagaattaaaaccgctaggaatcaaggtcatgatagcacaaccaggttctttccgaactaatttttatgatacttcactaaaagggactaaaaataagatcgatgattataacgaaacagctgggaaaactcgtaaagagaatgtcgttaatcataaaaatcaacctggtgatcctgataaaggtggtcaagttattgttgatacaattgaaaaagacaactatcctttccgtcttctcttaggtagtgatgctaccaagatcgtagctagtgctttagaagaaagaattcaagaaatcgaaacttggaaaaatattagtagtcaatcagattttgaatagaagtaaagcctcctaataaccggaggctttactttgattcagttattaaaatgtccagtacaaaaatgttcaattatttctaaaacttctgttaatttatctgtttcaatataaacttgagtctctttaacaaatttattaataaaattatcatcaaaatttccatcagcttgtcttttgaaactttcttttaataaatgctgtgctgcatcttgatactcaggtttcactctttttaaataatattcataaaacttagtttgtccatctttcacattccattcactccttgcatctatcattaccacaattactttaataatacttagtaatctcatttttattcattgcttatacatataaaatcatttttcctaataaaatacactcctttaaactaacgattttcacaatttccaagatatatttttccatttcataaactaacttatctacctataatgtaagttaacacgaaaaagcaataatccccggctctaagacactaacaatcaaaatcttccagaaataagagaagactgccatgattaattatatctggcatacttatcccaatttttctaatatcttggtattttattaatataacatttaaaatatcatatatatcttctaaaatggttcaattcttagtaagttcttcatcaagaataataatattttgttcatcataaatacgatgcatcaaccaaacccgctcactgattctaatgactgagatacataagatcttaacacctttatgggttgccattttcaatgacaagggttcaagtgatataactttttccctcaatatgatcaatcttatcttcaatcaatgtaagagcatgtctagcatcatatttagtaaaaatttgtggtgcttaaaacaattacatcatagtgatttcctactgcaaatagcttactataagatatcgtaaagaactagttgttaatccaccagtacaactgagcagtactctaattagtggccgtataaccagtttttatactctctactattttttcaaataccccaatcgtttgcttaagcgtcctcacttgaaaatgcaaataaaaaatgcgcaaacccaatatctagatttacacattactgttacttgattattcgaattataacaactcagtttattaaaagccaagaaaagattattttactaaaataaaaaagcctatacggcttaataaaaaaataaaaatagtcactgattaaaacaaatagtgtcaatagatattttagggagtagtgactatttatacaagttatctaccttgcactattataatctctcatgaatgttaatttaatatgaattaatcaacctttttataaattattttatttatttttgaaatttaaaaaagtgcatctttttaaagatacactttttattatcaaattattcagcagcttctgcagcttgtttgttttgatatctttcataagcaattaagaatggtgcataaattaagatagatgctacgattgcaattgcttgagatacagcacccatgatattagctcctgtagttaagaaaccatgtaagataggtggtgttgtccaaggtgtattgattacagcttttggacagaatccaattacagttaatacataaccaagcattaaagtaacgattggtgctaatacaaatggaatacctaagattgggtttaataccattgggataccaaatgtaactgtttcattgatgttgaataaacctggtactaatgagatacctgcgattgtacggttatcttcacgttttgagaaaactaagatagaaattactaaaccgattgtaaccccagaaccaccaaattcaccgaacatttgtaaccatgccattgcgaagatgtgtaaatcatcacctttagcattatttgttttagagaatgtttcgatattttctaacattaatggtgtaaataatgcttcttttactgcagctaacatgttgttaccatgaatacctactaaccagaataatccgataatgatataaataatgattacccctggaatagttgatccaattgcacctaaaggtccttggatataagttgaaattacgtcatttaaatataatccagtaactaattcacatccacgtccaattaacgcaatgattgctaaagtaattacagctggaattaaaacttcgaatgcacgagcaacacctggaggtactgtttcaggcatttttaattttaatccttctactttacgtaatgcacagaagatttctactgaaacaaccccaacgatcatccctgtaaataaacctgttgctcctaaagcaccaccagcaacacctgtaaatgtttgtaatgctccatcagctgttaattctaatgtttgtttagcagtgtctactaatgcatagttagcccatccactttgagttactgctagccagcaagcaagtcctaataaacctgcgaagtatccagtttcaccattagcttcaccgatttcttgagcgataccaaaagtaatcccaactgtgatacaagaaattgttgcgaattgcattgctgcaaacgctgggttaattacttctaaagccatgataggtttccagaacatacctaaccctgaatctgcattaactaatacgttacaccataaaaccccgatcgcacctgcgatagtcaaaggcatgaatgtttggaacgcatttttaattgcagataaatacttattttgcccacaccacgcaccaacgcggccaaggacatctgccattttgtccataattcttttcctcccttattgactacctaataatagcaaagggtgaaatacttggaaacgctttccccacattctgtaagagtcttacaatttttttaaaatatttaaaaatgatatgtaaatttattacatatcatgatctgtctttttttcatatttttgttcacaatttatctttctaattaagttaggataatagtctttttgaaataagattgaaaagattagatccattaaataatcactacttaactttgaagaataggtttctattttcgaaacaatattttctttactacacattgttaagcaataattcgcccgttttcttaaataactatcatttattgaagtaattgcaataatagttcccttattatccacaatccgatcaactatcgtttttatttcatgactctcaccagaataagatatcacgattgcaactgtatttttatttacaaataaagaacgcttatcttgatcatttggtgaagatttaaaattaacaaagtgatcgatcgaaatcatccgatgctcgaataatagtcccgaaagatacgaagctccaacagcaaaaatatcaataactgatgtttttaataacttttcaattacttgattaagtacatcatagtcgagtaatgctttagtcgcctcaatcgtatctttatataactcgcctaactgatttgtgacttcttgaatactatcattctctttaaaaggtcgattgtaatcaacatcagtttgataactagttaaaactgatgaagcaaaattgatcttaaagctattgtagtttttttcacccagtttcttgcaaaaacgactgatcgtcgctgttgaagtaaaagtcgcctcagctaactcaactaaacgcatattagccacttcttctttatgatcaattatataattagcaatccctttttcaatgtcactaaatccttttttgtattccagttttgataataaactcataaactacccccgaattactttataaatattgtcccaaatttttttccattataacactaataagggcatgttagtcttttttaacactattttaacactattcttttttgatttttctaaaataaaaaagcccttttggacttttcatcatttagattaaatagtcactaaattaaaatatgaactgtcaatagatatcttatgagagtagcgactatttctacaagccaactagcctgtggaaatataatactccattgttttataaaaaaatataaatttatataattcaggatagtattttcaaaattagcaattttaaatattaaattatgaaaattttttacataatttattttttattttcaaagtcaattacttttaaagcagtagtaacattactttgataatcctttacaagtaaagacacaaaaatgacatctagaacatacattgttgcagtaaatgatgtaatcacttctaaactaaggatatcttgtgacgagtaaacattgaggtaaatatcacaatagttttgtaattcaccctttttaccaccaattgcaataacatagattcctgccttttttaaatatttagcaatcttgatcatctcactattattgccagtaaaagaaataagtatggctacacattgacgactatttttttgtgataaaatgaaatgttcattgattccactatgtgcatcgcactcttttcctaaagtcatgattttaaaagcagcttgactggcaatcgtataactaattcctgttccataaatagaaatacgtttagcttgagataaacgattaatcacctgaatcattttattttgatctaaatccagccttgtctgtactattgatttatcataaatagttgggataactttaacaatatcttgatatgtactgttttcatcaaccggttcatcttttaaaagactactaattcgacttaattcattatactcaaattcaacctggcgtttaaattcttgataactattaacctccagctttttacaaagacgtattactgtagccttactcgtataagtttcttttcctaattcttccactgataattgatataactgttcagtatgttttaaaacatactctgcaattagcttttcgctattagtaaagcgtttcctctcccttagcttctctaagatcatcactatcacctcatcttttcctattatgacatagatatcaagatgaaacaaatttgaactaatcaattatctttttattaattaaaataaaggagattgaaaatcctcctccattttacaaaacagctaaatatcatttaaactttcaccgttcgttgcaataactttttgataccaccaaaaactcttcttgggataacgcgccaacgttccactaaaatcatcatgcacatcaacataaatatagccataacgtttagatacttgacattttgtattagcaacaatatcgattggaccccaacttgtataaccgagtacttctacaccatctttgattgcttctaaaacctgctttaaatgctcttttaaataatcaatacgataatcatcatttactgtataaccatattgttcatctacaaccaaaatatcctttgctccaagaccattttcaacaataaataacggaagctgatatcgatcataaaattgattaagaatatatcgcaaccctttaggatcaatctgccaaccccattcagattcttttaaatagggatttttaactccgctcattacatttccccgagcttgttgattaagtttctcatcagctgtagcacaataactcatataataactaaaagaaataaaatcgactgtattttttaaaatttcttcatcttctttcgtgatttctaaatgaatatgattttcttcaaaaaaacgtagcatgtatcctggatattttcccctaacatggacgtcagcaaagaatagtgactcccgatcacgtcggactgtttcctgaatatcttcaggctgcggggtcaatggatagattggactccctgcaatcatacaaccaattttaaaattcggattgattttatgagctatttttgttgcttgagcacttgcaacaaactggtgatgaattgcctgatataaaacttcgggattaatttgatcagcttttcctttaatcccaccaccattaaagggggcatgaagaataacatttatttcattgaatgttagccagtacttaaccttattacaataacgttcaaaacatacttgagcaaagttaagataaaaatcaattactttacgattcacccatcctccataattagtcgctagatataaaggcatctcgtaatgtgataatgtaactaggggttgtattccatatttagctaattcatcaaaaacatcatcgtaaaactgcaaacccttttcattaggaaccgtctcatcaccatgcgggaaaatacggctccatgctatcgataagcgtaatactttaaatcccatctgagcgaacaatgcaatatcttctttatagcgatgataaaagtcaattgcatttttctttaaataattatctaatggcggaattgcttcattaccaaataccccttcaggcaaagcatcagccgttgaataacctttgccatcttctaagactgcgccttcacactgattagccgctattgcaccaccccataaaaatcctttaggaaaatttttttctaccatcttcatgactacacctcttgcaatttatttagtgcaaaagtcaataccgcttttccatccatcttgccataatcgcgcatatctattaaatatgctggtactccattagcatcatccgcaatacttttttctagataacgcacctgtggtcctaaaagaataacatctgcatcttggctgtgattttttacttctgttgctccgactgcccagatttttgtttcaattcctttttcctgtgctgcttgttccatttttgtaactaatagactagttgacattccaccagcacaacataataaaattcttatcattttaattttcctccatctcatcaattctttcaattttaaaaattactggtcttgtcccatcactacaacaagcaatcatcatcttttcatcattagtccagcctttcataattgagccaccttgcaaagctgcataaatatagcgactgacggcatcccaagcctcactgcaaaactttccattcatcatattccaaaaatcatctttgccattaccacgctccaaaataaattcctgtccctctttaaacaatggacatttaccaacttgcggatccgctaaatattgatccgctaaatcttgataatactctcttcgtaataccgtaattttacacttagacatctgtttgctcctttcaaatccttttttctacacttttaatttaacatcagaaaataaaagaaacaacaggctcgtaaactgttgttccagtgtttcatttatatattatttttataatttattttgatacttgtggtccactaaaggcattttttaatcgttctaaagcttcttttaagacccaagtagggcaagcgatattaattctttcaaacccttctccttcttgaccgaagacatatccctcatctaaatatagatcagcagcaatcattttcttctctaattctagatagtcataacctaaatttctaaagtctagccaagctaaatatgttccttctaatggatatactgtaactgatggaaaatttttcttgataaagtctaccagtatgtcatagttatgatgaatcaatgtcttaaattcagctaaccatgcatctcctttagtataagctaaccgtgttgcttcaaaagataatgtgtttaatgtaaaaaatccttttttctcttgttgcgcaataaatttagctcttaattctttattcttaataataatattagatccttgcaaacctgcaatattaaaacttttacttggtgctgtacatgttacagtaatatctccaatcacttcacttaaaacagcaattggataatgtgtataccccggcatagttaaatcttcatgaatctcatcactaagaattataattccattatttaagcaaatatccgcaattttttctagctcttcttttttccatacacgccctacaggattatgaggattacaaagaatcaataactttgtatttgcttgttttgcaagttcttcaaatttatcaaaatcaatttggtaactattttcatgatttattaaaggacatctttgtactcgacgattatttaactcaattgcccgatagaaaggataataaactggcgtaaaaataattactccgtcattttcttcagtaaatgcagttaccccatcgcttaacgctggtactacaccattagataaaacgatccattctttttcaacttgataattgtgtttatccttcatccagttaattactgcatcgtaataagctgctgttccatttgtatagccaaatacaggattattctgcataaattcaagcatcccttcagcaatctctggtgctaatttcaaatctaaatcagcgactgaaagtggagctatatttttagcaactgcaggattatgatctttcatcccgttccatttagcagaaccattttgactccgatcaactaatgtttcaaaatcatatttcatttctctacctccattattaagcacctatatagttaagtaccttaataatagtatactctcacaatttataaagtcaaataaaaagaatcataacgattcttcattgtcttgtgcatattctttatttaaagctctttgaaccttaatataaatatctatttcttcattgctaaaactaattaaattcttaaaataacgtttcataattttcttatcaaactgaccatgtaaatcaaaaatctgcctcccgccaaccgttaagtataaattatactcacgattattatgaggattcttggttcttgaaattaatcctttttgttctagcttctttaaaatttgactgctggcacttaatgttttttttaattctttagcaatcatcgaagcatttattccagggtgatttccaattattgcaagagtgtgagtttctactggataaagcatcactttgccaaattgtcgaggtttactatcatattcttgtattaaatcataactttcgtcaattactttaatcatattatcaaatcgctcttgatccacaaaaatcacctcaggtatcattctatcaaataataaccaatgttgcaaacaatcataaaaagactggttttaccagtctttaaaggattacattaaatgtgattctttggttgtgtattcttgaactactttttgaatcttttgtggagtttctggttctaatggataccagcctttagaatacataagatcaaagacctcacgttgaatctgatatacctctttttgaatatctattaatttatttgctagttgttgatgagagcattcaatgataaaagtcgtataatcacttaataatgattttaaacataatagaacatcattgattctatcataatcattaaacgtattttcatttggtaaaattggttgtttcgttggatttgaataattttgattatccatttaaacaccccaataattcactataatgatttttaattgtgctattaacacgtcctaaagtcatcttaatatcattatcttcaacactttcttcgtaagcttttaacttcttcgataatacatataaactattcaattgatcattaaaagagccactatctttagtagatatcatttttggtggttgattcataaaattcctccttcaataatattttggttcttttataaaacaattatgcataatcatatacaaaagattaaaataaaaatattttttattttctacttataaatttttcaaatctgactaatactagagtatctttattaaaaaataaaaaacattattatcttcaataatgtttctttaccaaattaacagccctaaatttttatcctgctacttttattttattttcaatatatgccattactgcttctttagggatatttaataccgctgcaaattcttgatgcagtagatcttctgcttcttttttgtaccgctcatcagtttgactcaatcgcttattttgtaacaataaatttttttgctttgcttgaagattacaaatcaattgaatcaagccatcacaagtatattgacttatcgtttctttgtaataatctgttaattgtcttaaattttgattttcaataatctctttttgtactttaggatgtctggtcaataatcgttctaactcctctatcgaaatcaaatgacgcatatatacttgcgtatcaattggcacatacgtcttaccgtccataaaaataggatttaaagtataatactttcgggaattgggctgcttaccaatactaattactccaatattttcaatcctacaaacactttgattaccatatataatcaaatctcctttttcatacacataaccacctagctttctattaagtatatgcttaatatatctattataccgcactattagttactatatgcaaaagtaattaaaatatactaaattttcttttttatgcagctaaagactacatctttttatatttgattttactatttaaatcttgttaataatttcaacagttttacatgtttcgtatatcattagggcttgctttagcaatgatggtgacagtattttttagctaaaaacctttattgttgtaatatcgttaatccaactagaatttgttaaaacagtaagatagattgaccatcgtttaattggtatttcactttccattcaatattttattcctaatgaagatactattttagttgaaatattattaggtacttcggtttatttttaccagaatataaatataaataaattatcaatattgacagtgcgctaaatatatcgatcgatggttcttttagatactaaaacagcaatagaaaatcaacttattagtttaatcagtgaaatatttatttcatgaccaaactaatattatctactaactaaaaaatgcagaccattgtttgcctacattttttgtgcatattcttttactattttagaaatcaaatttaacaaagcttcttcgtcattaacttcataatcaggtttaatatccattgctttaagtccctttttatttaaccaaatacatttccaattagcatttttggccccaatcacatcattttcataagaatcaccgacatagatacaatctttatccgtaattaaattaaatatctgtggatctggttttgaataaccaacaaccgatgaaatgtagatatcctcgagagcaacccagttgctcatctttagtctacgtaatttttccatttgatgacaagcaggtccattagtaattatccctattcctatatgattatcttttaataaatctaatatatctttgattgcattactagttgtaatgtcttgttgatatacataatattttgtttgaaatgctaaagcatgtgcttcatcaatttcaagataatattcttttaaggctgcttggatacgatagatatacatttcatttattgtaacttgaccagactggcttgcctcaaatattttatcactatatttacgaaatttgataaaaatttgatatataggcaaagtctttattttaggaaatatttcaataaatgcctttttaaatggaatgaactgatcatatagcgtgtcatcaacatcaaaatagaatttcatctttttaccgtttataatttattaatcatttttacaacattatctactgtaaaaccatatcttttaaacagttcatcagcaggtgctgaagctccgaagctatccattgttatatatttgccttttaagccaacaaactctccccaggacattcttgaacccgcttcaattgcgattctcttttctatacctggcggcaggatactttctctatattcccggctctgctgtttaaatatatccatactcggcatacttactacccttatcgctttgcctctgatccgtttctttgcttctactgccagtgtcacttctgatcctgaggctatgatgattatttccggtgttccttcacactcatcaataacatatcctccttttaatgcttctcggctagatcctttgatctgtggtagattttgtcttgataaaaccagtgctgttggtgttgtttttgatgtcatcgccagataccatccagcattagtctcctgtgcatcgcacggtctaaatacattgaagttcggcatcgctctcagcatcgtcagctgttctaccggttcatgagttggtccgtcttcacctacaccgatactgtcatgcgtcaatacatatatcagtggcagattcatcaaagctgacaatctagccatcggtttgacatagtcgctgaatacaaagaacgttgatacaaaagtcttcaatccaccataaagcattattccgtttccaatccctgtcatcgcctgctctcttactccgtagtgtaaattccttcccctgtaattctcggcactaaagtctcctactttatttaaatatgtttttgtagatggtgctaagtctgctgaaccacccatgaaatttggaaatagttcctttatccggttcatcgcagttcccgacgaatttcttgttgattcaggtttattttcaaatttccagaattccacatcgttttcaagtactttattatagtccacctcaaaatactgcttccataattttttcatctctggatatgttaccagatagtcatcaaacatatccttccaaatcttatagattacctcgctgcgttcctgctgttttgctgtattgagataaacttcctcatctatcgcaaatgtcctatcctcatcaagtcccagtgtcctttttaattccctgacattttcttcacccagtggctctccatgtgcactggcttttccctctttagccggacatccttttccaattctggttttcacttcaataaaggccggcttttgagataccctagcttgatttatcgcacttaatatttcgtcaagatcgtctccatcttcaaccgtgaatgtatcaaaaccaaatgccttcattcttccctgaacatcttctctaaaggcaatatccgtgcttccttcaatcgaaatattatttgaatcgtataaaacgatcagtttctccagttttaaagtgcctgcaagtgaaaatgcctctgacgagattccttccatcagacagccgtcaccgcctagtacataagtaaagctgtcaaatactggatatcccggtctattaaaaatcgctgccaagtgtgcctgggccattgccattcctgttgccatcgccatccctgctcccaatggtcctgtcgttgcctcgacccctacagtatgtccgtattcaggatgccccggagtcagtgaatcaagctgtctaaactgtcttagatcctctatcgttaatccatagttatacaaatgaagcagactataaagcagtgatgatccatgtcctcccgacaagataaagcgatcccggttgacccacttccgatgtgttccactatgtttcatgacctttccccataagatataggccgccgccgctgaacccaaaggtagtcccggatgtcctgaatttgccttttcaacagtatcagcgcataatgctctaatggtactgactgtttttctatcaactgcttccatattagcctccaaatactgctcgatagtctttttggaatttttcaatcccctcagcagtcaaaggatgtttcagcatttgttcaataacactgtaaggaacagttgccagatccgctccggctttagcacattcgataacatgacaggcgtttctgacactggctgagatgatctgcgctttgatatcatgcgttttgaatattgcggcaatatctctgatcagctgcagtccgtccatcgagatatcatcgattcttccaacaaatggagaaacataggttgctccggctctggctgccaggattgcctgcggaacattaaaaatcaatgtcagatttgttttgatcccttcaccggacagtacccggcatgccttcaagccctcagcagtagttggaagcttaacaaccatattcttatggatttttgcaatttcccggccttctttgatcatgccttcagcatcaacagttgtggctttgacttctccgctgataggaccgtcaacaattgcagcaatctccttaattacctcattaaagtctcgaccttctttagcaataatagagggattggtagtaacaccacaaataacccccatatcatttgctttttttatttcttcgacattagccgtatctaaaaaaaatctcattttatttttctccttatatatattgtgataacacttctttttcacattcattaataacttttataatattattctggttattacatgattccagcttttcaatcagctttgcatcattgaccattcgcattaatttaacaattgcaggaatatgttcttttttatctttactcgctaaacaaaagataaccctaacttgtttattatcgaaccatacgggttcatcagttacaatcagactcattgaacttattttaaccgatgatgtgttcccactatgaaataacgcaaatttactatctgttacagcataaaaccctgattccttaatgacactcatcaagccttcataatattcagatttaatacatccatgttgtattaaaatatcagttgaaagtttgattgcatctttccaattgctaaatgatttaacataacgaatacaattttcacctaataaatcacttatattatagtatttcttaggaatcctaacatctttatagccaagttcttctttaattatttcaagtactttttcacgctcaggagaatttaaaaatcccaatcttttttcaattgcaatataattcgttaaaacattcttttttctaattcccaccgcttctaatttattatgatcatgattatcaaaaattgcatttacaacaatcaaagttttttttactgggaggattaactttgacgttgaaataacaatatctatttgctcccatttctgataatgctctagatcatacgctggaatactatcaatcacttgaacctgatattcatttcttagagtatcttttaaaagtgctgtagcgccaaaacctaagccacatattagtaaaatatttttatagtcatttgctcttaatctttgaatacttgcaataaaatgaatagtaatataaattaattcttcttgactgatctcttgtaacggttgaatactcaatacaattgattttaaaacttcaaatacatattcataactttgtggaatcactgtttgacttaactcataaactcgaatattattttttattcgttccaacatcggtgccacatgattcaataatccttttattaaaatcatatcccgtaaaaaaaatactcctaactcatcagacatcattgtcacaagttgaattataatatcttcagtcattattaaatccaaattgatatcaacctcaccatatttattagtataactagaataactcataattagttttttttgattatcatctaattgtttattaattatcatttccagttcttggagtgaataatcttctacatcaatttttttaggacaagatggcaattgcttctcttttataatataccagcaagtagttaatatatttgctacataccaatcaaacgaatcatcactaaaagtccaactcatcattttcattttattagtgatccagtcataaatatgaagaatatcaaaattatagattctatataacaatttcattaattctaattcaaatgtattatattcagaaagtttattactaaataaatagatatatttttttaactcattgacccttaaaggatatcccttatgatcatcttcaattaaatgaaaatgacgattatagactagcgatagaccatactgattaaattctttaataagagtatccaaatcattttgaattgaacgacgcgatacttgaaatttttcacttaactttttaatatttagactatgaacatcaaacataataataaaacgtaataattgcatcctctcatcagctgaaaaaataaattcactatcttctaataaaatatttaaatctaaatcaattgggacaattaattgtcctttagaacgcttttcaatttcagacaatccttttaaactcaaagcatcgttaatacaatctatgtcgtaacgtacattacgttctttaagatctaaagcattgccgatttctttataactagattcttttttttgatttaaaaatctaataattttaaacattctagcactaatcatcccaatttcctccgtttatttttcttctttttctgctatatctaaatttggctttgtaaaatgtaagattgctgcggatactaatactcctaccagcatcgctaatacataccataatttgccattgactactggtaaaataatcaaaccaccatgaggaactaatgcttcgactccattcatcatccctagtgccccacctactgcactaccaataataattgctggtaaaactcttttcatatcttttaccgcaaaaggaatcgctgcttcagtaattccaatcgttcccatgaataatgccgatattcctaaattcttatcatctgcactatattttttacgatcaataaaagtagataaagctaatgctaatggcggaattgcacaagcaattcgatgagcaccatttggagcataaacaccttctgccatcaacgcaagagtaaatgccgttgccgtcttattaattggtccacccatatcaactgctgtcattgcaccaatgattgcacctaagagaactgcatttcctccttgcattccacttaaaaatttaacaagccagtccatacaagctccaatcggaacagaaataacgtaaatatagataattcctaaaataaatgttgtaaaaataggaacaattaaaataggcatgattgttttaatcgtatttgaaactttccatgttttacaccaacgaactaaataaccagttgctaaccctaaaatcattgcgcctaagaatcctgttttaacctctgattcaccaattggattatttgctacatatcctaagatcatccctggagctatcccaggttttccagccaatgaataagcgatatacccagataaaattggaatcatcatagcaaaaccagctgatcctaaatcatttaaatttttcatgaaaggattagttacttccattccagtatccgttgctgtccctgttgctaaagcaaccgctaatagaatcccaccaaccacaactgaaggaagcatatacgaaaccccagtattaaaggctttttgaatatctttccatactttattatttttcataacttcttctcctataagttttctgcttgatctataaccctaacggcatctttaattacatccccaggttcgacttgaattactttaccagcatcttgtttttcttcaaaacgttcttcaccatcgatccccactgcaattgccaaaataacagcatccgcttcatcaatttcctcttgttctaattcgttttcaatccccatacttccttgagtttctacttttacttcgtaaccacgattacgacattctttttcaattgcttcttgagccatgtacgtatgcgcaataccggttgggcatgctgtaactgcaacaattttcatattcatttcctcctataattgttcattgattgcatttaatgcacgatatgcatcttcaacatcttctacttcaatcaattgctttctaaaattatcatctaaaagtcttctacttaataaagaaataaatttaagatgaatattattttgattatcttggggcacgcctataaggaaaatcaattggactgattgtttctcatcatgattccaatgaaatgcatcctttatttgaacaaatccaataaaagcacgattaacagtatgactaattccatgaggaattgcaatttggtaaccaattgaagttgaagccatttcttctcgtttataaaccgcttctttaaaatcttttttactattaattaaatctagtttaatagcctgatctgataataattcaataacatcatctttagtcgataaagcttgctttaagaagaccatttccttatgaattgctttttcctgcataatcattccccttatccttttttacaagcaagcatctttgatgttaatccttccatattaaaacatctaacatgtttttgcatttcttcttttagtttttcaataacaaatctttttccatcaattttaatgcttgctaagttttcatataatttattaatttctaatgctactttaggtttagaataagtataatgaccgcataattctgtaatttgtaatgttgtttgctcatctaaattatctaaatccgacatatctacttcatcagtaagccattttttccatttcattgaatgaattgattcatacttaataacattttctaaatttgatggctctttaatcatattaaatttagcaaactgtttttctacttcaattaactctaataaagccatcgtttcaatcgttccaaaagctggagcaacattcattgctgtgatatttaaaggtaaatgtgctagtaatttagcttcacttaaataatcaccattatgttcctttaatcctactccatatttagttgatattgcacttaattctaaagaattttcataactgaaattcccaacatttttagttaaacgtgttaacgttccagtttgaccaacgataaaaattggcattggtaaatcatgttcttgagtataagattcaattctttggataaaattttcatagcgatccatcgaagttaaaccaccacttgtttcttctgtccctacttcatatgcaatttcacgttcaattccatattcttttctaacttgctcacaatactcaattaattctatagtacgattaaagacaacatctatatccactactttacaatattcatcaggatccttagttggatcaatatgtaataaatcaaaaccatttaaaatatcttctttatatgactctttggcaattgccatagcttcatcttccggtaaatgatctgctctttctttatctctttgccatggtccaccatgatcacggcataaataatagacattatcataattaatttcttgcgcaatctcttcgattttttctttgaataacttttgatcactgttgaatacatatccaccaccaaatttatatgcatcaacttgattacgacttgcaatatacattaatggaaaatctttttcttttgaaatttctaaagatgcccgtaaaaaattttcagacataggtccaatcccaagtaatgtatgtttttctccttttgaattaattacataattaactgcttctctaattgtaacttttttattcatttttatcttctcctcatcatttagcaattaatcaaatgtcgacttttgatttatgagataggtatttgtttctatctacacatatatcatattcaattagtcacaatgacataagataaaacaaatgaaagaaaaagttacaaaaattgcaccctattgttgattaagaaaaaatagaatttaaactcaactagagcataaattctatttttttaaatcagcatcgctgctaataataaataattaatttttcttcatataaaactactatcttttaatcttgatgacataataatagcgtacctaataacatatattcttggagataatcaattaaaacaatttcaggaatataatctttaggaatatatttagctacctcttttttcaattcttcaatattagtaattaaaaaacaacatataacaataatttgcggatctaaaaaactgattattgatgtaacagttttagccattgcttcaatggctccttctggtgtttgatgtaattctaaaacatcttttgaatatgataatggcaaatattgtatttctccagctacatgatggtgtccagcaatcaaacgatcatttacaatatgtcctgcccctgagttcgaactaaccggttgaaaaacaaatgacagtgatgaacagttttctttagaactataatagcctaaagcaattgtattagcatcattactaaaaacaaatttttgcgaatatttcaaagtaaaatcatgagtaattgaaattttctctagcccctttatactcattgagataatctgatcaccacgtataattcccggagtcgataatccaataactttaatatctacatatttagccagcatgctatcgattacatcataataatcttggattgataaagtaggtttgataatttcattattttctaaaatactattattttcatcatataaacggtacacaatatgaacacgattactattcctaattaaagcaagacacaatgttttaacaccactaggctgcatatttttagctttcaacggtttatgcattccttttgccaaggttcgtttataattacgctcctcttcaataatcgataacatcttttttacatcatatttagcaaatatagcaggcgggatatttaaaacgattttattttttaaaatctcacatacctttgcatacatatatgagatttgtggtgccaacataatcatgtcataatcttcactagccttataaagattattatagctaaccgcagacacttgaacatcgatattaagtaactttgttatttgattgatccgatcagcaaaataacctgtcgttaacccaccagtacaacaaagtaaaacttttaaagctggtttatttgttaattgcttgatcgtttctaacatttcatcaaataattgaattgcatgtttgatatttttaatttggaaatggagataaaattcaacttctttttttattaaattttcaaccgaaaattcaactatattcatattataaaaattaacctggctagtactatatttattcttaatagcaatcgttttataatcatccgatagacttatagctaaatttttattactttgcattaagatccactgtttaaatacctctatataaatttcactcaagaattcatccattttttcactcctttatcttctaatgattttaatagtccctgattatacatacctttattatattataaaattcatagaaaagagaccaattgccgttattctgataataatttttcaatttaatataaaaaaaggataaaaagaaataaatttctttttaatctccaatttaatctttataaaaatcataattaaacattaattttggcaactattaaaagaaacaaagctaccgccttgtttctctttattcctacataaccgtgataatcgactttccagccgttactttaccatatttttctaattttaatgtttttcctttagtatctagaaaaacaatcataattgtatagtcaatattttcatttcttaaataattaagatctagtttaataattttttcaccagctccaactttttgatttttcttttttaatattgtaaatccttttccttttaaattaacggtatctagtccaatatgaaccaagatttcaacaccgtcatctcgtgtaattccaaaagcatgaccagtaggaaataatgtcgttaatactcctgcgcaaggggcacagacctctgacgaggtcggaacaatagcaaccccttctcccattactttttttgaaaatacattgtcatcaacatattcaagattaaaactgactccatttacaactgcatatacattatttgtatttttttgattattttttaatgatttaaatatctttatcatagtattaactcctaaatttgctaatgactattttgttggaagtttttattttttactggaacatcttcaaatcctgagaaataactcaccacactagatacaacaaatgccgcaataattgcgataatgacgccaataatcgtttccccataaataggaagtgccaaaatactaggattaccataagcaaatgcctttactccaaaaaatccagcaatacaaccgccaactgcaccaccagccataacaccatacattggcttttttagacgcagattgattccgtagatagccggctctgataccccggctagaatagccccgacaccactactaatcgcttgtgaacgtaattctggattcttagtttttagtgctaccccaaaacaagctcctccctcagcaacattatgaacaaattgtgttggccttaaaaaaccttcataacctaatgatgcaatactttgcatcattacagggccaaaaacagtatgcattcctgacattattacaaatggcaatacaccaccgagagctccaagcgcaaatggaccaatcgtgctttgcatccaaactaagaaattaataaaatattcaccagcaaaaaaaccaattgggcctaatacagtaagggttaaaagacttgcaagaacaagtgttaatccaccaacaaaaattcctttaaacattcccggtaaatacttattcaaaagcttttcaatatttgcaactgctacagttgataatattgctggtaaaaaagatgaagcataacttgctgaataagctgtgaagcctaatatttttaagggctcttcagcacttaacatcccaataatatctggatggatcagtagacaagctactatcattgaataaataggtgtacttcctaatctgattgctgcaccgtatgctacaaaaacaggcataaagtagaaagaagtattaacaataccatttataactagatatgtttgattatcaacaatttccggccacgctaatgaggttagtaccaaaaatacttttattaatccagctacagtaagcccaggaatcattggtgtaacacatgcagataagaaattgaaaatattttttattcctcttttccaaattggcgaatcatctttttctttaatatcttcatccaaaatttcatcaataatttctgctacttcaaaattataatttttaactacttgagtaaatgtcgcagataaatttttccccataattatttgaaattgaccggcaccaaaggttgagcccaatactccatcaatttcattaatcttatcttgattaactagatttttattttttaatacaaatcgtaatcttgtaacacagtgggttacatatttaacattatcctgtccgccaatcgctataatgatttgatcggctatttctttataatccatattattctcctctatattattcttgaaatatgtactaataaataaaatcgttccgcctctgatagtacataatcaaattcttcatttaaatatctttcgattgaatctaacgtaatacctatttttttattaatatctgacttagcacttattattaatttttcaaaattctcatcatcactttcaccctttatcacccgctgcataaaaaatttaagatgaatcactagcctagagtaatacagtgaatcttccggtagttcaagaccaaaattagcttcaattatatttaaaatatcatctatgctctttaaaatactcgttgttttgcttacattattattaaactcagcattaattaagtgaaatgctatagcacttgcctcttttttatttaaatttatttgataatatctattaatcaaatctaatgctttaaggccgacttcatattcttcatgatagaatctttttatttcttcactaactaaactataactaccataaccctttagataatttttggaaacaaagttaatatggtctgatagcgatactaataatccttgattaaaatttctatttaaatcagtttttgccatatctataatttcttgggtcaattcaatacatttaaatggaatttcattcagtaaggctttaaattgaattttcaataaattattttgtaacgtataaagcttgtaattttctttcattgttatataatcattaactttatgattaaatcctacgccattaccaataataattatttctgttccattttctaatatttcaatggcattattatttaagattttattaattctatagtatttatttttcatatctaatcctctacatttattaaaatgttaaatcagacccgtttgttttaattaccttcttataccaataaaatgaatcttttctataacgctgtaatgatccttgtccataatcattcatatcaacatatataaaaccatagcgtttcttcatttgtccactagctaaagatattagatctgtacatccccacatagtgtatccaaaacatggtactttatcaatgacaatagcatctctcaattgttttaaatgttcagccacatattttattctgtaataatcatgaatttttccattttctaaaatatctactgctcccattccattttcaataacaaataatggtttttgataacgatcataaatttcatttaaacaatagcgtatacctaatggatctattcctgcaccccattgggtcttttttaaatacggattgggttccccacccatatgatcaactttagaaccagcactaacaattgaagaacgataataactaaatgaaataaaatctaaagtatgttttttaatcaagtttcgatcttcctcacttactttcaatttgacatctttcttattaaaaatatcttttgtataatttggatatgacccgcgagccattacatcaacgaaaaataatgcttcacgttgcttacaataagtggcaaaaacatcttcaggattacatgtagctggataaatttcgcttaatgcaaacattgctccgaattttatgtctcccataattttctttccctgactaattgctttagcacttgctacaaacatatgatgaactgcttgatatctcgtctgactatcttgtctatgggttcccatttgagcgtacccacctaaattatttatttcattaaaagtaatccaatatcttactttatctttaaatcggttaaatagtgttgttgcataatttacatagcatccaatcgtttctcgccccgcccaaccatcatataattcacataaatgaaagggtacttcatcatgacaaattgtaatcattggttcgatattatattttaaaagttcatcaattatcatttcataaaatttcaaaccatcttcatttgctttttcttcatcaccatttggaaaaattcgactccatgaaatagaaaaacgataaactttaaatcccatttctgcaaacaaagcaatatcttctttccaatgatgatagaaatcagtcgcttgatggctcggataatatatatcatcataaatatacggtatagctccatcgggaattgagtctcgataatcaatactccctctcgttccattatttaattttaaagtaatttgtctttctttatctatgtcaccagcagtttcaaaatcatgactcgataagcctcttcctttttctttatatccaccttcatattgaaaacaggctgtagcacctccccataaaaaatcttttggaaacctgatcattttcttacctctcttcctctctaatttgccaatataaaaagggcaataccaaaaagaagctaaattcttttttggtattgccccttgtttttcccgggtaacaagccatatttaattgacacttatattttatcatataatttattttttgcaagggctttcaaaaaataaaactatttacaatattttgcttattaaaagtaaaagcacaaacacataggtaaagagactaagtaaaacagctccaatgtatctaattatcaaaataccagtgagagtaaatatgccttttttgaatttggaatttctatcctcataatcattagaataaagtcaatcaaataaatatctaaagctattgatgaaaacaatgttttaaaaagatttgattctaaaatgattttctccatttacaacatagtcacttatcacatagatgctaccagcaccatgaagattgctccaatattaaaagtacttaaataagttattgtcaaagatggcattatcgcttgaacaaacggcaaaacaaagcttccaatgttatatacagaagcatttaacatagagacacctttcattgttttggaatctcttaatttaacatgatagccaacaaccgccataattatattatttaaaatttctagaataataaaaagcatgatatttgatgtcaatcgaatctcacggttcccgcaagcaatgtccatggacatgtaatgtttgttataagtaaagcaagaacatacgaatcactttctttaatatatcctcttaattttataaaacatgctaaaaagataatcaaaataaataccattgcttgttgtattactgacgtcataaatttttatcttctattcttttgtaattactatgcttatacttgatgtatcgattttaataattcaatacccgtttttgttttaaatattttttccataaaatttcttatatcttcaacggaataattgctgctgtttcaagagcttttaagtcttgctgattcagttttactaattcaccaatgttttagcataagcatgcacttttaagaaatgtttaatgttatagttatttccattagcatatttaatcattttatttgcaatattataaatcatcacaatccttcttaatctaataattaatcctaataaaagaataatcttcatatctattaaaataaagattttttatattctcacttattttcattatttaataaaaaaagcgcaactaaattacgctctaaacttttatatttttgatagcagtacgattgtctcaacatggctagtatgagggaacatgtcaaccggatacattacctcaccacgatagccaatttttgcaaaatacttgatgtcccttacctgagtacttggatcacaagaaatataaacaacttgtttaggattcaagatttttacagcatccataaattcctgcgtactgccactgcgtgggggatccataattacacaatcaactttttgcttctgtttagctaatttaatcataaaagcagaagcatcatcattaataaatttaatattttcaatcttattcattttagcattattgatggcatctttaactgcatctttatttaattccacaccagtaacttccttagttctattagctacaatcattccaattgtcccaattccacaataagcatctataattctttcttgacctgttaaattcaataaatctagagctttagaatacagtaattcacactgttgatgattaatttgataaaatgattttggcgaaatcttaaacttcaaaccacacaattcatcaactataaatcccttaccataaagaatcttttcttcattacctaaaaccacactcgttttacgtttatttacatttaatacaaccgtcttaatacttggaaaatttttaatcaactcattacaaaaatttttggatcctttaaatacattatcattgcaaactagtactaccattgtctgattagtaacaagagcacgtcgaattaatacatgacgcaataatccgcgattacgattttcatcataaatactaactcgatatcgttttaataagctttgaatcttcttaataatcatatcactgagttcttcatgaagaagacaacgatcataaggaataatcttatgactatcctcttcataaaagccaaattcatatctatgattaaaagcaacaattattttattacggtattcataaggatgccccattccaatagtatccttgacttcatacatgtctaatttattatcttttaacagcttcttacaataatctgttttaatctttaattgtctctggtaatcagtattaatgtatttacagctaccacatttcttctctattaaacatttcattttatcacctagcaacagtataacataactaaagcaaaatactaatcaattccttctctcattattatttcttcataaataaaaacaaggtatagtttgttaccaaactatacctactattaatcttcagatatctcttcttcaatgtgccccactacttgaaatgacttatcagtatactgcataatttcaaatttattaccatcaggatcatgcacccacatttgataggtatgtgatggacctttagaaataggtgtatctattgcaactccacattcaactagttctcgataagttttttctatatcctcaaccaataacgcaaagtgtgaataccccagcctctggttccactcatcatgtggcgcttgtccttcatcctttggaaatagttcaataaactgtccaggggcaatttcaatataaacaatgataattctgtttggatcaacttcagctacttcactatatttaccacgatttagtcctttataaagtcccgcccttgttacaattttaacttttaatcctaacttattttcataaaagtctctcatcacatccatttgatcagtgaaaaaagatacatgcatcaagcttttaaattccatttgtcttctcctttaattatcatttgtaaatactattttttcttgatttcttgcctcattcatgactttagctactattaaacttaattccagcatctttttagcaaaatcataatcattattatcaatgattctaataaattcaataaattcataatataagcgatgttcacaatcatcaactcgataaatttcttcagtgccatcgttaaaaataatttgatatccggtcatctgattaacaggtttatcaattttaataacccctttatcaccttgaatcgttgaaataatcggtgctttgcaatctttagcccctatacttatccccttaaacgaaccataatcgtacattagaataccacttgtatcaatttgattctcaatatttgccatatacccaatacttactggttgaccaaataaacttattattgcattaacattataaacattgatatccatcaaagctccacctgatttatgataatcaaatgccggtaaaattgttccttgtttaaaagcatcatatcgtgaagaatattgactataattaaaattcatgattttaatatttccaattctctttatatcttctttcaattttttaaaagcaggtaaataatggatattaactgcttctaaaataattagatcgttttcttgagcaatttcttttaattcttccaattccttaacatttgaagtaataggtttttccattattacatgcttaccttttaataaagcttttttagcaaaactaaaatgtaaatgatttggcaaggcaacatacactgtatcgatttcacttcgcaacatttcatcatagtcataataacaatgatctagatgatattgcttagcgagaatagtagtctctttcttagtttgttcagtccctaaaatcgaaattgattcaatctttaacttatttatagttgttaataagtctttaacaatcatccctgttcctaaaatacctaatttcatttaatttgcctccctaattatttctgttaattccaatatcctttttgtatcttccaaactatgaagtgcactctcagttttatgagctcgtacatcatcaataaagcactgaatctccatagtcatatcatctccaataattggataattgcgttcaaccacagtaccatcattttttatgattttataatcaataatacgattaaacattggaatctctatttttccaaattcaccttcgataattgctaaacgctctttattacgatcaattgccccttccacaatcgcagtacattcattattaaaattaatttttgctttaaaataccattcaactccagcaacaatatcaatctgtgaattaacattctttatatctgaatccaccaaagctaatacaaaaccaagcaaataacttcctacgtcattcagtgccccaccttgatcaacgttaaataaatatgaggtagtttggtgagcagtagcatcaaaacaaaaattagcttcaatttgtttgattttaccaatcaatgataaatcctgttttaaatgttctaaaccaatattaaatttagtctttaatgcttctaagcaatatcctttttccgtatatacttttgttttaatctcctcaatatctgcaactgtcaataccattggtttttctgataataccgcaatatgattatcaagtgcttttaagatccattccttatgatatttatgaggtaaggcaatgtatacagcatcaagttctcgatcctgtaataattcgtcataatcttgatatattttaacttctgggtgagcttttacatattcatcatcacttgttaaggaatgagatgcaattgcataaatctttccttcgtcagtgtattcaatacttttaacaaattttcttgcaatattcccaaatccaataattccaaaattcattgattttgcctccttttccttgttataacataactatttattatttaaatatatttataatattctggaaacaaagtactaagaaaataaaaaaaatactgtgatttttgtacttttagtacaatcacaatacttttatataaccgtcataatataattgacccataaccagctaattggcataacaataaccattgcaggaatcatatccgcaattggaaattctttaaccttgatcattctaaatcctgtagcaatcattaaaaagccaccacaagctttaaaatcattgatcattgctggtgtagtcaatggaaaaataaactttgctgataaaaataaaataaaaaagattacaaactgcggaatggcaattacagataccacataccctaaattacaagcaaaaatcacagcagtaaaaaaatcaagaattgatttagaaatcaaaactccattatcacccgtcattcctgaagttaaggagccataaattcctgttccactagcacaaaataacacaataatagtaattaaagtagattgaaactcttccgaacttaaatcactaccattatttttaaatattttggcaattggcttttgcattaaaattgctcccttattgatccaatcactaaagtgcagtgataatcccacaatagttccaataattattgaaaagattactgccggcatattttccattaatccaattgcattgattcccatagccatagcacaaatcccaaaaatcaaggttatttctgtcttaagtctatgacttaatttatgacctaataatgcaccaaatattccccctaatacaattgataaactattaataatgactcctgttggcattatttttccccctttataatttgaaaattatttctctaaaagattccattcactctctttataaagaatatcatttttattagataattgccaattaaaatagtttcttgtcttattaagaaaaaaaaggacataattctataggctacaatatttgaaccataaaatacatgatgttataatataaagacaaaaaggagatgaactatatgacaaaagtagatattatatctggtttccttggagctggtaaaactacattcataaaaaaattaattagtgatgtatatccaggagaacaaattgtcttaattgaaaatgaatttggtgaaattggaattgatggaacttttatgaataatgctggaattgaagtaactgaaattaattcagggtgtatttgttgcagtctagttggtgactttgaagcttcattaaaagaagtattagaaacatatcatcctgatcgaattatcatcgaaccttctggtgttggaaaattgtcagatgtaattaaagctgttagtgatgtacatagtcatgaattagaacttgataattatattgctgttatcgatgctaaaaaatgtcgattatacacaaagaattttggagagttttttaataatcaaatcgagtacgcctcacttattattttaagccgaactcaagatataacagaatttcagctagatgagtgtttaaaaattattaaagaacataataatcaagctaatgtcattacaaccccatgggatcagcttaccaaagaaatactaactaatgcctttagtaatagtgataatcttcgtgatgaattgttggaacaattagatatttgtcctatatgtgcccatcatcatgatcatcaccacgatcatgaacatcatcataatcacgaacatcatcataatcacgaacatcatcatgatcataattgtgagtgtggtcatgagcaccatcatgctgatgaagttttcaccagttggggtaaacagacacctaaaaaatattctaaatctcaattagaaaaaatcttaaaagaactaagtgacagttccgcctatggaaatattttaagagctaaaggatatgtcgatagtattgaaggtgattggtggtattttgatttagtccctggagaatatgaaattcgtataggaaaacctgactttacaggtcgaatttgtgtcattggcgaaaaattagataaaataaaattagatagattattcgatgaggtcgcttaatggaaacaagagtatatattttcgcaggctttctagatagtggtaaaacctcatttattaatgatactttaatgaatcctgatttttatagtgaagaagacaccttattaattagttttgaagaaggtgaagttgcctataatgatatttatttaaaaaaatctaatacttcattggtaacattagattttgaaaattttaccacctatgatctaaaacatttagaattagaatatcgtcctactcaaatcatgattgaagctaatggaatgatggacctgaatatttttgtaaaagaaacgattcctgaaaactggaaagtggtccaagtattaacaacttttgatactactactttttcaatgtatttaaataatatgcgttctcttgtatatagtcaggttgtctttagtgatcttgttatttttaatcgctacgatccaaatattagaaaatccatgttaagaaataatattaaagcgattaacagtaatgctcaaatcatttatgaattagctaacggcactatagatacaatgaatcctgaagaagaattaccatttgatattaataaagaacatttagatatacaagatcatgattttggaatcttttgtatggacgctatggatcatcctgataaatataatggtaaaacagtcaaaattaaaggtaagtttatcggtctagatcgtgtcattgaagatggttttgtcctagggcgtcaagctatggtatgctgtgaagaagatacctcattgattgggcttgtctgtattagtaagctagcaaataaattgattcctgaagaatggatcgttgttgaaggaaaaattacagttgattatgatccggaatatcaaatgaatgttcctatattaacagtggagcacctcgatgtagtccctccattaaaaaaccaatatgtgacatttgattaaaaataaagatgcctgctttattataaaaaagcagacatctttattattttccgagtttttcaactatttgaactactaattcttgaccattcatctgaccataaacgaatggatcaattacttcgatcggtttttctggcaataattccttaactcgatacaaatcatgttttatttgaggagcaataaaaatataatcagcatatttccccaattcattaatttttaagattggataagcatatacttcataattatacccctcttgactaatataccttttcatacaattaactaaaatacttgttgaaactccctgtgcacaaaagatatatatccgcttcattattcagcctgcaaattattttcttcatcaagacatttcttatcgtatactttgatgaatggataccaaataaggccagatacaatgaacattacaacaaagataagcaccgcacgccaatctaaagtacacaagtattggaaaaacggcatcggaatattagaactagcagcaattacagctttacccataatgccaaaattcatacagcaccaaattattcccatattgattgtgtaaaaagcaatccatggaattcctaaaattggattaaacataattggagctccatattgaattggttccgcaatattaaaaattgctggaacaatcgatattttccccattgatcttaatcgctcacttttacattttaagaataatagaggaattatgtaacaaaatactccagacatttggaacattggtaaagtgaatatttttgtagcagtttctccggctgcataagcagcagcattagcacctgtattggcaatcaataacggaagaattattccagatacaacattaaacccatgtactcccaagaattgtaaaaatgcaataataaatgccatcaacatacagaaccataatgattcagaaccttgaatcgccggtgttaataaactcattatccaagatggtaatagcatccctgtaaaattttgacaaagtaaagataatccatagaaaccagcaacgatcaagcacatcggaataatcgcatcaaatgaagcagctactgctggaggaacactatcaggtaatttaatttgaatattacgtctctttagtaattgcatgatttccacggttaccaaagcaacaaaaattgctaaaaagattccttgtgatcctagataagttgcatccatattattatcaacaattggtgctgccaaaacaataaatgataacagcgatacaatcggcgcttgtaataaatcaagtttatatgttcgtgcatggtaataagcgatagcgcatactgcaatgactccaaataaaccgaaaaccatattatacgggaataaaattgcatcctttatcgtctcactataactaggtatgaatggaaatatatctggtaatgctgaaataagctggaaaatactcccaaaaatcgttaatggcattattgccattaatccaaaactaatcgattgcaaatgcctttgtgttgctaacttattgcccacttcaataagtttatcttgtaattttttcattttattttcctcctatatatttgctgcaataaaatacgcatcattagttgctccaactacttgtcctaacttttcacaatcaccaaacatcatcgtttcatcagctattccatacaatttaaaagcttcctcacgatttggtttcattccaacagcaattatggcattatcacatttaataatagattcgccatttttatttattattttaactccgctttcactaaatcctaagcattgactatttattaaaatggtcaactgtttttcaaatcgttttaacaaacgccttaatcctgctcgatataaaatatgcccttgactagctatttggtcagtcatttctattactgttactaattttccacgttctaataactctactgctaactctattccaacttgtcctccgccgacaatacaaacattatcttttaaagaatccaatttaggataaatgttttcaaaataatcaacatattctaattgttcccctgggaaatggaggcgaattggtgaagctccaatggcaacaagcaccacatcaccatttagttgctctaataaatttttagtagcggtcgttttatacataacttgaatatctcgcttgttaatttggttttctagataatctcgatatgcttttaattcctgtttatgcatttcatgttgggccaaatttaattgtccccccaatttatcacgttgttcaatcaaaataacttgatgtccccgatcatgtgcagttattgcagctttacaaccagcaggaccaccaccaacgacaatcacttttttaataatctcacttttttctaactttaatggtacccgatgttcccgacgatatcgagggtttacagagcattgtacatttgtatgttctgtagcactatgatagcattgtaaacagcgaatacatggtacaatatcatcgctttgcccctgcattgcctttcgtggtaaaaatggatctgcgactagaggtctacccattgaaataatatcaactacaccttcttgtaataattgctcagcttcttttggcgtcattattgaaccaattacaccgactagtttattaggaaagttttgtttaactaattttgcccaatgaacattagttagatgcggttcaaaaatactttgacaatgtttcccattaacactataccaagcttccaatcctaattcaggctctattatttgatcttctggaaaatatcctggaatcatatccatcccagctgatacattgatcaaatcaacatcatcttcgattctttttaataattccaacatttcttcaaattgataagacccttttaaataatcactcgctcctaacaatataacaattggaaagtctgtgccaacagcattacgaatcgttttaacgtgctctattgtaaagcgcatacgattttctagcgaacccccatattcatctgttcttttattaaatactggagataaaaactgggttgttaattcttcatatccaacgtacaaatagataaaatcaaaaccaaatcgtttgattgccaatgcatcatttcttgcctgtttcataattccctgaatatcttcaagcgttaattcaactgcacgagcgccacttcttgttaaatatggtgatggtgctaaaacctgcttaccatcataatgagctcgaatatcattagctgcatcttgttttagtcgtggtacacaccaagttccaaccttagccccatactgacgggctactgaaatagattcacgaataccatcgcgatcatgttttggaaattcaccattggcattagccgcagattcaattgatacaaaagtcattgctgctccacctacagacttatctataatactaacatttccatagtgagtcgtagataataattcatggctcttgggaatccccatcgttgatgcaataattctatttttcaacatcattgtattaactcttaatggttgaaataaatgtggataatactgattcattttctaactcctccttgctctcttattgtatgtcaaatagcttttgcatccaaaccagcttttgccacgatcatggcaaaagctgaatcacaattttaagatttctatcaagaagtttgttataatatgataaaggagtgattattttgcttgaacttacctctagacaatttttaattattcgtctattacaaaaaaataccgttccactaagtgctaatacgctatcaagattactagatattagtcctagaacacttagaaacgatatttttcaaattaataaaaatattgaggattttcatatttcttcatccaaaaatggctatcaattaactttattaagcgaaaatgcccatatgcttataaatgatattaaaatatccgaacaatcaaagtctaccaatataattttacaatatctgcttaatcacccatcatgtcacttattagagttatcagaaaattgttatatgagtgaatccagtgttgctcgctgtattaaaacaatcaaaccgcttttaaacaaatatcatctaacagttgaacgaaaaaatgatattttttcgttacatggtagtgaatatgataaaagagctctttttgctcatttaattgggattgaagcttcacaaccaataactagcctacaacactttcaacagtattttcaagattttcatctttctgaagtagaagctataatcgactctgttttaaagaaatataatattcgagttgacgatattcactatcaaaatcttgtgatgaatacatctatcacgcttcaaagaatttttgttggaagcgacatcgaacccctgccgttttcatactccttatcaaatgacgaaattatttgccagctgtccaaagacctatgtcataacctagaagaatattttaatcttcattttgctcaaacagataatgaatatatgcaagtcctttgtattggctcgattaaaataaacgaagaaaattatgaaacccaaattttatataatgattatagttttgtttataaaattaaagaaattctcgatgatcttgttgaacacttttcattgcaacttaattatcaaatgtctttaaatcattttgctttacatattcatcgtttattttttagaaatcattcttcgctttactttcaaaatgacttccataataaccttaaaaatacccatcctttcatttatgagttagctgtttattttgcctataaatttcaagaaagtttcaatattacagtgaatattaacgaaattggcctattggcaattcatttaggtttaatgattcaatccaatgaagaaaataaacaatatttaaaagcactatgtatttgtccagagtataatgatttacgaaagcattttgccaatcaatttttattaaactttggtgataatgtacaattaattagttttatttcttctaaaaagaatattcaagactatcattttgattttttgatttctactattaatgactatgaaagccccgattgtatggtaatcagccccttgctattatcacaagatattgataaattgaatcttaaaatcaatctattaaaagagaaaaagaaaaaagatctgctaaaaaaggaattatctaaatacattgatcctaaactcttttttagaaatgttgattttacatgtaaaaaggatgctattttatttttatgcagtcaaatgttaaaacatggtgatgctaaaacagattttgttgatagtgtatttgaacgcgaaaaaatatcaacaacttcattttttaataaatttgcagttcctcatgcaattcattttggtgatgtaaaaacccgaattacttttttattgaatgacaaagcaattccttggggtgatacctccgttcatttagtcatgcttatttcaataaatgaaaaagacataatgactttcaatacaatctattcttcaattattgatcttttattagatgatgagtcttttgatgaaatgttgaaaatcaaaacatttgatgaattatcagtttatttagaaaatcatgtttaaaaaagttgtaatgctttattcattacaactttttaatctttatgcaaagatatttcatttattaaaatattatgttcccgatgatttgaatccacaaaattaactgtaccattttcattcaacttagtaaatgtaactaaaccataatcttgaaattcaacctgtttatcctttaaataagcaatatcattagcataatcaagaattttatcatacgaaccttgctgataaagactatagtatatcttaaaatatgttaacattgctatcattagtgatttaacttgatatgtctggccagttttcatcttcattgaagcataatcaccgtttattgaattaacatttaatccaactccaactacaaccccttctaaatcagtttgatagattgcctctactaagattccacaaatctttaaatcatcaacataaatatcattgggccacttaattttagcttttattccataacgatctagtaaccccgccacactacaagcaactagctgtgtcattttatgaaggtcttgaggttttttaaaatcttttaccaaaatactcatcagcaagtcatcaccattcttactttgccaaacgtgtccattccgaccccgaccatttgtttgataattacaacgaactacacttagattaggaagtttatttaaattacgttttacgtaatcatttgtagaatcgacttcgtctaattcaatataactcataatatcaccccattactatacttctattatattagaaatttaggaaaacaacaaatatttattataaagttttattctaatgcaccctttactttttttctagtgaaacaacgatcttgacgattagctaaagcgctaacccgggcttctagcagtatttttctaccactttcattacgagtataaataacctgataattaccaataaacggcttcatatagccagcaaatatatgcgcatcttcttttcttttagcaaaactatcaggaattgcaaaataacaatctaatttattttttcgtttaggattataaagaatataacgttgattatcaatagatgcaaaaaattcattgatgcatttggcaaacaaagccttatcatgccctgttccccctaataaatatattgcatgtatcgcattaaaagaatctgtttcaacgcgactattcaaagaatccagctgattggttttttctaacgcatttctaattcctttgccaaatatttctaaacgacctaaaggatttgctaatgtataaagttttttgatgctcaaaagaatactcataacaaatattccaacataaattatcaccactagatattctaaaatatctatcaaggtcaatgattttagaaatggtattccaatgacagcaccaataatcccactaaaaacaattatcagtaaagttcttaaagcatccataaacataacgacagttataaattcttctttaacttcagtttcttcaacaatttcaattttgtcatagacagctaacgaatcttcccatcttttctttaattgactacgctttgaagatagtttaagcatatctctattaattttttttatatttcctggactaaatggcaatttaattgcgctaagtcgcaagattccattttcaattatatcctgctgataatgcaaccctaaaaaatgttccattctccttgcaagcgtttgaaaatcttcactaccgccatcatcataatgacccgttaacttttcttttggtctaacacaaactaaatgccaaatattacttgttttattgggcgttttctcaaaaactctaatagctcgtccacgcatttgattacttaacatatatgagcctacaaagctagccaaaataagcgaattaacacacggtgaatcccaaccttctccaagtaaagatttagttcctatcaaaacttgcatataaccctgcgcaaatacctcactgattacccctgttataaaattacggtttccactaatttcaacttttacataatcatctaattttccaatttgatggaagctgattttactaggttcttcaactaattctattaatgctgtttgagcatccttggggataataatcattgtgccacataaaacaccaaatttaattgctgtcttatttttagcactatcacgccttagttgttcaaaaaatggtaaaacgcctaaattattcacatctttgctttcatcacctaatgcccgttcgtattcttttcgaatataatcagtaagaatcaaaagtcgtaattcttgtttcatcgttttatattcataattaacaatttctttaatgctttcacatttaccaaccgaatttattagcattttttcaattgcttgatttaaacacaaagaaacttttcgtttttcgattaaacctttagacttcaattcacgaatcaattcatcacggtattgttcttcaactcgatatgaagcaatatcatcatataaaaagccttgcagtaaaatttctaaccatttaagtgataagggttctaacgatttatatcctaaaagcttttgatacttattcgcactgcacactcccttagtatttaaaaaaattatcattgctgataaatagctcggatcatctaatagctcatcatcacttacttcctcagtaaaaaagcgatgactcataatagccttacaaaaatattcatcttgtattagctgctccaaaatactttgactattttcctcaaagatacttaatttttgtttttcttgagaggccggataattgaaataaacataatcttgatgtggacataaagtaccatctttaactaattctggaactgttatctcttcatcaatatcaccacacatatccatatacctagtccacatgcttagattagaatcatatggcggagttgctgttagagccactgtgaaaatattattaaatgcttttttaaattcttctaatgatttccaccactcacttcgaagatgatgacattcatctagacataaagttcctaattggcattctttaaaattactgattacatcaaaattatgataatcaacttcttcaactgttttaaattcatcattagtctctactagttcaccacaataatgactcatcgcactatgtagtgcctgatatgtcacgacagtaattaattttggtttttttaaatcttgagaaagatattgatcgcgattttcttgtttaactaaaaaagcttcacaaatacgctctacccattgttcacgaatcgttattgatgggactaagattaaagccgagtaatcgattctttttattaattcaattcccaaagttgtttttcctgaaccaggtgcagcaacaatatgaattttacgatcttgactataacggtcatatttatcaagaacacgttgttgataactgcgccaagtgcccttgaaatgcaaaatttgttctaacatccaatccctcctattacctttatttatacatatcaaccttaaaacatcaatacaaatcaacttaattttatgataaaaattctccttccactaaaaaagtagtacaataataatcaaaggtggtgtaattatgacgatgtatattcaaacccaaaatcaatatacccaattccaaagtgatgagttaactgatttacttggtaagattagttttactatcaataaatttggactttggcaaagtaatcacgatactagagcaaattatattactgatgatattgaaattgtctattatcgagaaggtgggtctattacaaccattggcaataaaaaatacacctgcccaccccacagctttctcatcatcgaaccctataagctcaacacttcaataaatactggaaatactaactacagctattatttttttcattttgatattgaacccctatcattgcgccaacaatttattactctcttaacaaaacacgggcatttaatatataaagaagaaataaaagacttcaaagaaatgctagaacgtttattaatcgaagctagtgaaaaagaaattggctattcaagcattataacctctgctttgattcgagttgttgtagagataatccgcgctcagcttaaaaggaataatgaccatatttcacaaataacagatttaccacatatcgaattagttaatgatgccattaagtatattcatgaccatcttcatgaaccaattaaactaaccgcaatggctttacaactaggtgtttcaacaagtatgttatataaatcttttattgcaattttagcaattcctccactaacttatattcatcaacaaaaagttctctatgctcaaagaatgctggctcatggtaaaagtgttacaatgattgcaaatgacctgggatattcatcagcctatcatctatctaaaacttttaaacaaatcacaggggtcagtccacgtgaatataagaaaaatattaagttattataagcatatacgaaaatgtatatgttttttaattgatataatatgttttatatatatgtaagtgctatcatatctttataagggaggtatgaatttggaaaataaatatcaaaaactctttcaaccaataaaaattaatcagctggaagtaaaaaatcgaatttttatgtcgccaatgtcaacaaactttgcaacaaaagatgggtatgttactgatgaaatgatctattactatagcagaagagcaaaaggtggcgttggtctgattgtaactgaagtaacaatgattgagccaacctacaaatatattgctcatactttatcagttcaagatgattcctatcttgaaggatggcaaaaattagctaatgaaattcataagtatgatagtaaggtcgtagcccaactactacacccagcatatatggcaattcctttcccggaaacaccacaattagttggtccaagtgaggttggtccatactatgctaaaactcctccgcgacctttgacaaaagaagaaatcagtataattgttgaacaatttggtgatggtgccttacggttaaaaaaagcaggaatagatggtgttgaaattcatgctgcacacgcacatgcattactaggaggatttttatctccactctataataaacgaattgatgaatacggtggtgacataactcatcgcattcgtctacttttagaagtaattgcaaatgttcgaaaaaaatgtgggcgtgatttcgctattattgttcgtatcagcggtgatgattatgaagccggcggacaatcattacacgaaggatgttatattgctaaaagattagaagctgctcaagttgatatgatccatgtttctgggggaactactatccaccgcggcagctcaattgcaccccctggaacaccacaagcgagtcatattgacagcgcacgagaaataaaaaaatgtgttaatatccctgtttcaaccgtaggacgtttgaatgaaccttggattctcgaagaagttttagaaagagatttagcagacgtatgtatggtaggtcgctcactcttatgtgatcctgattttgttaataagatcaaaaatggtcaagaagatgatattcgtccatgtattggatgcttgggatgtttaagctcgaccatgttaaaagatcatgttgaatgtggaattaatccatcattgacaagtgagaatgaagaaactgtaacacctgcgacaatatcccaaaatatcctagttatcggaggaggtccagctggattagaggcagcttatattttatcaaagcgtggacacaaagttacccttgctgaacgtcatcatacattaggcggcgcaatgatcgttgcaggttatcctattgctaaacagcactttgctcaaactactaaatatttcattaaacgagtaatcgattgtaatatcaaaattgaattaaacacgattgttgatcaagcctatttatcacagcatcattatgatcatatcatcgtcgcaaccggagccaaaccattacgacttgatatttttaaaaatcatcctcatactggtaccggacaagatgtgcttcttggcaaaatgtggacaggtaaaaatattgtcgttgttggaggaggctctgttggctgtgaagttgctgattttgttgccccattagttaatgaccgccatccaaataataaaaaagtaactgttattgaaatgaaatcaaatattattatggatgatacttcaccatcacgaagtattttagttcaaaggatggctgataaaggcgtgaacattattactgatagtagagtcgttaaagttacaccaacaactctcgaatatcaaaaagatggcaatactattacaattgagaatgttgatacaatcattgaagctactggttattatgctgatcatgagttaaaaaaaaccctcgatcaaatgcaacttagctacaacgtcttaggtgacgctgcaaccccaggaaaaattaaaaatgctataagtgacgcatatcatttatgtaaaaatatttaatcaaaggagaaaatatatgaatttactaaaacctattaaagttggaaaaattactttaaaaaaccgaattatgtttcccccaatgacaaccgggtatgaagaaagagatggttcaatcggtgaacaaagttttaatttctataaacgtttagcgcaaggcgatgttgcttatattgttttaggtgatgttgctccagtcaatactgtttcccctacacctaaactttttcatgacggtcaaatcgaagctttcaaaaaattaagcgatgccttacatgagtatgattgcaaactagggattcaaatctttcatcctgaatatgatgttgatgctctagcagaattatttagaaaaggtgatatgcaggctgcacgtgctaaattacatcatgacatgctacattatatcgatgaagtaactgaagcccagcttacagcaattattgataaaatcggcgcttgtgttaagcgtgctgccgccgcgggggtggatgttattgaggttcatggtgatcgtcttgtcggttccctttgctcaaccattctaaatcaccgaaatgataattatggtggttcatttgaaaaccgtattcgctttgctctcgaagttgtcaaagtaattaaagaaaatgctccagatatttgcatcgattataaactgccaattatcactgaaaatccgcttcgtggtaaaggaggcctaaaaattgatgaagctattaaattggctactatcttagaggctcatggagttgatatgatccatgttggtcaagccaatcatactggaaatatgaatgataccattcctgcaatgggaactcaaccatactgttttatgaataaatatacaaaacaaattaaagatgttgttacgattccagtgtcttctgttggacgaatccttactccccaaaatggtgaatccttgattgataacgggatttgtgacattattggtttaggtcgttcattattagctgatcctgattatgttaaaaaattaaaaaataatgaagctgctcgaattcgtcattgtatgatgtgtaataaaggctgtaccgatgcaatccaaaatagacaatttttaagctgtgttttaaatgctgaaaatggttatgaatacaaacgaataattaccccagcagcaacaaagaaaaaaattgtagttgttggagggggaccagcaggtttagaagctgctcgggtagcaaaaacaaaaggacatgatgttattttatttgaacaagacactagattaggtggtcaacttaatattgcagcgattccaccacgtaaagctgaaatgaatcgggctatcaattacttatcaaatgaaatgaaaatattgaatgttgatttaagattaggtaaaaaagcaactagtacagatatattaaacgaacatcctgatagtgttatcatcgctgttggtgccaataatgcttccctaccaattcctggcagtgatttaactcatgtgttagatgcttggaaagttcttaactatgaacaattccctagtggccatgtagcgattattggcggtggtctagtcggagcggaaactgcagaatttttagcacaaatgggcttggacgttactgtcatagaaatgcttgaagaaattgcaaaagaagaatcatcaactgtaaagccagtaatgtttgaagattttgaaaaacatcaagttaaattattgactaaaacaaaggtaattgaaattaaaaacgattgtatcaaagctgctaatggcgatggtgaattaacgattccatgtgattatgttattttagctactggagctaaacctaatccatttgatgtcagtgaattaacagctcacaatattgatattcatcttgttggtgactgcaatgaaaaagctgctgatattaataatgccattactcaaggttatttagcagccaacagtatttaaaactcttattatctagactaaaaagaattaatcataacatttaaatgtttaagattaattcttttttattcttattaactatctactattactagccattctaaaccacgtataattttttcctttgattgatactgataattgataaatattttctggccaagtacatccgccaaagcctccatccccgatagcatgaatatcacatccggtttgtttcattaaaagggcaacctgccgaattgtatcctcatcggcacattcgaccgaactatttaaaaaactcatggctaaagtacctggtttatagcgatgaatatattctactaattctctaatcatatctactgtgattcctgctctagtccctggagctggtaaatcgatacagtcagcaccagcatcaataagtcttttaataacatctttggtatcatatgctgctaaaggatcacctagtaccttttcttcgataccatcttcccacttgccagcaaacaagaaaatatcatctccacatatttcttttactaatttggttgcttcaattacatcttcaatcgatgttccagaacctggattaccacccaatacaataaaatccactcctaaagcaactgcttttaaaatatgttcttttgttgctaacattccagccaatcggtaaagtgttttttcatcagaacgcttttctcccttcttaggacaccctaaataaacaccaattggacaattgcatttttctttaagctctttgatagttaagccgcacaatcctggattattttcaaaattatctaaatctatagtattaagcataaccatatctgcaccaaacgaacaaagcaattcagcatttgtcacacccattaccgtccctgggccagcaaaaattaaatgttgtcccatgataactcgaccttccgatttatagatagattcttttaattctaaaggacccattttgtttatctcactctttgaagcattaatcaatctttttacgttgctcataatttttcctcatttctagattttgttttcttcaagtgttttttcttgattactttttttctctgcttctaaagcctgattgtcacaaatcttaaaaaatgggtaataaattatacatgataacaagcacataattacaatcatgattcctaaactaattcccccacctaaaataaatcccgcaattggacctggaattgtcattacacttaacattaaggcgggaatattcacaacacctgtaaccatcaacaaataaccaataatcataaatacaagtggtgttaaaataaacggaataaacataattggatttaatacgattggaaaaccaaaaataacaggctctacgatattaaacatccccggaacaaaacacacttttccaaacgctttaaaacgttcgcttttagcaaatattgccatatcgcaagtaagcccaaataaacatcctggtccaccaataaactgacaaaaaacaaagaaaaacatataagttgtgactaaggttacaggttctccggccatataattatttaaatttgtaattgctggttccatccaaattaccatcatgacagaaagtacaactgaagtaccatgaattccaacccaccataacagcaataatattaacatactaatcaacatggctggaaaactattacctaaacttactaaaggcgcttgaaccatagtataaataaaattttgaatatttccataagatgttacagcaaatccagaccttaccaataaaaacaaggctgatactaaaaatgctggaacaacagcttcaaatggtttagaaaccatttccggtaccgaatctggtaattttattttccaattatgattaacggcaaaagcaaaaacatatgccccaataatcccacataacatggcagtgaagataccactagcacctaagttatcaactgggataacattttttatcaatgttacagctccatttgtattatcaacattgttataagaaaatggtgtaaccaacaatagtgataataacgaaacaattgctgtttgaaatggattaacattaaacttttcacctaaattataacctaaagcaaaaatgaaatataatgctgttaaattacaaacagcaacccctacagctaaagcatcagatattccagtagacgataaaaaatttgtataccagtctcccaatggtaaaccctgaaataatgaaaatacagctcctcctaataacgctggcatcactttcataaatgcgccacttattgcacttaaaataaaattgttttcaatcttctgtgcaaaaggtataactttattttggataaaatcattcataatttttcctcctcctaactttataactacattttatctagaagtataatcatttaagagtacataaaacttttcattagtccaaaataaaaaccaataaaaaaaataagtgctaaggtttcattttttgaaactttaatacttatccttggttatttaatcttgctaataagctttcaataatcttcattaattcaaatttcttcttaatccttggctgttcgtgtatctctaaaaaacgtttatgagtatacgagctctttaaagatatgatataattattttcgtcatttaaatgtctataaatattcctgatcaaagcattggatatattataatcatagtatttttctaaacttatctgaagatgactataaaaatataacgtatgttcatccatattaatagctaaattgttatcttcttcattaattatataaatatcataacctaatacataaaaatatttcaaatacattttccaaatcaacattgcttctcgctcaccaaataaaataatttgatgacaatgattacatgctataactaaatcatcaagtttatcacgatcatcgagcaaataaataaaatcacaaatcacagcattaaattctcttacaaaagtctttttaaaatccgtgaaatgactagtttttatacttttacaaaatctaatgattgatgatttagatagaccggtatcataaataacatcctctaaagatagttctattagcttttccctttggtttaaaaaatatttaacaagaatttgatccgtattattgatttttgcattcattgatatatctaaaagtatatcgatcattttatcactgctcctgataaataatctcgtgataataaaatttaatcaaatcaaaataatacaacaacaaatactcagtctcaaacatttcattattagataatatattaattacctcaaaaacattgtaatgaaaatttatttttgtttcgcctgaaaaaataataactttattagctttatttcctaaaatcgacactaaattatcatcagataaaaaaagtctaccagtacctgaaatcaatataattaaatcattatcctctatttcaatagaattatcttttaataaagacgacattatcactgtcttccccattgaaatcatatcaatttgaaaattaaaaagaattggagttatcgtaggggaagcaacaataataactctctgactttgagctatttctttaatgatcaactttaatttcattttatcattgaattctaatggataatcaactaaatgtgaaaccgccgcagctaatcgttttttgttaaaaatcttataacctcgatatatttgatctttacgaacatccaattcactttctaatctttctttaaaaatcgaataattagaataaccaaatttttttaaaaactgttttactgttggaactgaaacaaaacagccatcagccacatcttgtaaagtaatacttcctatatgattaatattttctataatatatttggcaatataataatttaaatctttattattagagttattaacaattgataaaaaataagctaagcacataaacatattatcttcctccactcattattaccattatataatattaattaaatttattcatttaaaaattagctttcttgtaccagcaaaaagctccaatcaaatttgcatcattataataatgacacactttgatctctggtggagttaccggaactgggatgcaatcaaataaatcactcacttctttctttaacattgttaataataacggctgagtactaatccctccaccaatactaatattctctaaatctaataacatttgcatattaaaaatatatcttgcaagatttttagtataatcccgtagtatttctaaactagcaatatcattatgattagccttgttaaaaaaggctaatccatcgatcgaatttcgctctaatgcaaatcgtttttcataatttctcgttaaataacctacaccgccaatcaatccaaatgtattttgccaatcaaagtcatgtttagaatcaattaaagaaaacgtagctgctccagcaaaataattacacccacgatataattccccgttaataataattgcgcatccaactccagtacccaatactagtactgccccattactcgtttcttttaatgagcctctatacaattctgctaatgccgcacaattaccatcattttcaatcgaaactggtacgtggcatttactccaaaggatttgtttaatatttttattatcattaaatctataactaccaccattttttattaaacctgtaaagggattcatttccccacaataactaatcgcaattccggataatttcatgtgtatagttttaaataaatccactacccaggtaatcatttcatcatgactttgaaatattttattttctttatttacatcatataactgaaagttttcatcaataattgcatatttaactccggtgccaccaaaatctaaacataaatatttcattatttaatccctcatttcttaacactttaaagttatcatagttaaaaaaaatataaatactatataatttttggttgtgtcaaaaaatgaaacatagaaatctaatatgaactgttagctatgattattgtattgcagcaaataaatctttatctttgttaatatcttcttgaatgacttttttgatatataaagctaacatatatggcattttttcttcaaatgtatctaactggcaatttaataattccttgactttagtcattctataattaatcgtatttcggtgcatatataaatttttggccatcgctacttgactgccatcatgaatcaggtaatagaacaatgtcttttctaattcactatgatgtttttgatcataatctattaaaggctttaataaatgctgatacattcctgataaaatttgtttatcctcgattgaaaataagatttgataaactcccatctcttcaaaaagaatcatcggatatttaaattgttctgccattgcaactgcagctcgagctcgtttataacttaagattacttgtctaaaatctgtcattggcgttccaatacctaagtgaataaatcttgaaggcattcgcttctttgttcttttatacattttatcagtaattttctctaatgaatccggatctaaattatttacaattaatacaaaatatccatcaaaccaaaaaaatgtatatgggctttgtattttttcaaaacataattccaattgaaaagaaactctacgtcgttcaattgcatcaaactgatcagaatcttcaattccaattaaaacaacttgaaaaaaaccatccacatcaaatgcacctaacaattgctgccgaacctcctcaacaacttgaggagttgtaaaaacattctgaaataattttgaaatctgattgtcttctcgttgtgaatataaacagcgcatactaaaatccttaattaaatctgccatgtgtacttcccagggtgtcgttaacagcggaaaatcctgctcattacaatagtcaattatatcttgaggaatttcaaatatatatttacctgtattgataactaatccaacactatggtatttaaccaaacacttgataaaatcaaataacgaatcgtgactttgaaatcctaaacctgttgtaactgccaattcttttccccataattgttgaataattgtcgtatcctcaatcatgtgaacccaactcatcgcatttgaacagccctcacgaccagctaacaattttaaatgatattgctcttgagtttgtactaacgcatcttcaatcgtaaatcccattttactcacttcctttatatttattttaccattatttgtgcatgatgcacaaataaatcttatttttttattatttctgtctctataattattaaaatattaatatataatataattgtattaaaaatagaacatctaggagggacataacatgaacatttcttatggatattacgtactaactgacaactttgatacttgcccaacttgggttcgtgatgaaggatatttcaattgtgaaaacttttcaaaattctttaagttttttaaaaagaaataaataataatgagcattcataacgaatgctctttttcttttaagatttaaattatgctattagataattattttatatttaaagcagcttcataaccttctttaactgctggtaaagcattacctgccttaattgcgccacctactacttgaacatcttcacataattcatttgcaattttttctaacggattataggctttatatccaaatgctaagacaactaagtcagcagaaataacttctttttctccctgttcattaataaatgccactccatcatctaaaatttctgtcacagtacaattagctctggcagttactcctgattcattcataattggtaatagacagctcatattaatgggatccatatcagtcaaaacagctggtttcatttctagaactgttacatgacgatgcgtttgagcaataaatgtggcagtttcacaaccaacttcgccccctccgcaaacaacgatatgctcaacttttgtagcgatttttcctaataacacatcttcagcattgactacattttctttatcgatacctttgactgccggcaccagcggtcttgctccagtagccaaaataatagcatccgggttttcttgttcaatcatctcttttgttactaaagtatttaaatgtacttttacatgcagatcctctaaattctttttaaatacagatattaatgttgttaattctcctttaccaattggataagctgcagatctaaattgaccgccaacttcttcctgagcctcataaacagttacattgtgacctatcattgccgcagtttcagccgcctgcagaccagcaggtccccctccaacaatcattactttttttgctttttctacaatgttcattgaattttcatattcacgtcctacccgtggattaactaagcaagtgacttcttgattaaaaaataatggcatttcacatccttgtagacacccgatacacattttaatattcccatatttttctgcctttgctttattaggtaaatctggatcagtcaatgaaccacgccccattccaataaaatcagctttatccatgttaattaatgtatctgccatttgcggatcgttaattcgattagttacaattactggtaaatcaaccaatttctttacttgtgctgatatctccatattcaatgcatgttccgtaaacattggagcaattactgctctatttccaggtgaagcataagagccattagaaatatgaataccatcaaaacctaattcttcaaaaatcatacataattcataagtttctgcttcagttcttccaccatgaacatattcattaccagaaagacggacgataattggaaaatcatcaccaacttgttttctcatttctaaataaatttcagcaactattcgtactctattctgtagacaaccaccatagttatcaactcgcttattgacaaatggtgataaaaactccgctaataaataaccatgggcacagtgtagctcaattccatcaaaaccagcttctttagcgcgtttagcagcactaccaaaatcttttactaattgattgatttcagcaactgtgatatctcttggttgttcttgacataagggacattcaattgctgaaggagcaactggcatatgatcttcattagcaattctagtagtttgtctacctggatgatacatttgacaaaagatttttgattcatacttatgaaccatcgttgttaattgtttatttccttcaatcaattcatctttatataaaccgggaattctttgatatcctttaccatattgttgaactgcataatcctcagtaataatcaaaccccagccgcctttagccttttcttcaatatatttcatataacgctcagtaattttaccttcaatcgtacaataatttgtcaccattgccggaactactaaacgattaggaatttttacagttcctatttgataaggggtaaataatttttttaaagccattttaatatcctccaatccttttataactttattttacagtatcaaatgatttgaaggtcaactctaatttattatatgtgatattattcacatattcttttttaatcacatatattttactaaaacaacataaaaaactctcaagctatttgagagttttttataatcggaatttgtatttctaaataccgtttaaaacgatcaccttcatatccacgccccctaataatcccccgtattggtaactgtacatgataacctttatcttgagcatacattactgctgcttcataacactcatgactaaactgtcctaacggtcccatttctattaccgtgcataaacaataatgagccggaataattgtatacttctttttataagaaatacttaatccattaaaatattcctcatcaatagcaaaataccattcatctttatctttattaaaacaaacataactatcaataaaattaatatatttatcatttaataaaaatcgaatattatcttcactagtattaactttatcataatcatcaccaattccatctacaaaatcaaaagcatattttttattaattttctttacccaataatttgataaatttaaatcagctacctccagttgcattgccaactctgtgactcgttttttcaacatgactttataatcaatctctttatttagtcgcctttggaaaatatgtaactgattttgaagcttttctctataattaaaattaataaaattaggaatttcttttattttcattcctaaattctgatactgtaaacattctaataaaatatatatgtcaaaaatactataatagcgatacccattcttttcatctcttataggatcaataattcccattttttcataatacctaatcatttcacttgataaattaaacaatcgtgaaatatcccctattttatactggctattcataatatcagctcctttacaaataattttatcacttaatcttcctatttaaaaaataattttattattagtttttataaatcaactattggtagatttataaattaattaaaactcgttataatcaaaatataaaggagaaatcaatagatggattgtattaaaattggaaaatttattgcgacatgctgtaaagaaaaaacttaacccagattgaaaaactaaatgtaacaaataaagctatatcaaaatggtcgaaattttatcgatgcttcattttatcacgattttcgcgatatcttaggcattactattaacgaattattagctggtgaacatctcaatactcaagataatcaatattactatgaaatgaatcttcacaatcgtattaacagttacaataacataaatcgaaaaaataaaataattattttcatgatttttagtacattgattttttagtcattacgtatttacaaataaaaactatatggatttttatcatggattcaatacatctaaaaatcattatttagaaaagcaaattcttgatctatttcattctttatcagtccctggcaacacacatccaaactttgatgaactttattatcggaaaatatttgaacagtctgatagtagtaaaatgtactatatttataccataaatactaagcaatattattttattgaaaatatattctaaacaaaataaaaggtatcacgaattatatgggagagggtccgtgataccttatatgactattatagcatatttaaaaaaataagcatttaatctgattaaactttaattagtttctccaaaagaaatctagatttcaagtattttagtctaaatatattatacttttaatctctattacaaagatttagaaatctttatcaaatcaactaaaacaaatctattctacatttcagttagagcattgttttttataataaatcatttttacaagtcatatacctaactaaccactataccaataattactttaataatatttcaagaaattgatacttaaaatattaatattcaatttcttcaagtgcatttttcaattgattcaaagcttgtcttaaatatgctcttgggcaagcaatgttaattctttgaaacccttttccttcttttccaaacatcgttccactatctagccataatcgagcatgttcaatcaataaatcatttaattctttatctgaaatttgtaatcttctaaaatcaagccaaagcaaataagttccctccgggataatcaactttatcaatggtatgtgttctttcaaatattcatctacaaaccgtgtattttcaaataaatattgctttaaatcttcaagccagcttgaacacgattcataagctgtctggcaagctgctaatccaaacaaattacactggctataaccagtactggcaatagcttttttaaattgtaatctcaatttttcatcggcaataaaaatatttgaaatttgtaatccggccaaattaaaagttttagtaggagccgtacaggttattgtaatattctgtaattctgtctttaatgatgcaaaaacatgatgctgatgccccggataaataaaatcactatggatttcatcactaataattttaacatcatttttaaggcagatttgccctaattttaatagctcatcttttttccaaactcgaccaactggattatgtggcgaacataaaataaacaattttactttttctttcttaatcttctcttcaaaatcatcaaagtctatttcataatgagcgttttttaaaactaaagaatttgttataacacgtcttccgttatcaataattacttctttaaaaggataatatactggtgtttgaataattactccatcacccaatttagtaaatgcccgcactgcttgtgctaaagcaaatacaacaccaggcgtcttaactatccattccttttttatttcgtaattaaattttgaccgataccaactataaatagcttgataataaccatccttactatcactatatccataaataccatgatttaccacatcatataatcgttgttgtatttctggagcaacgataaaatccatatctgccacccataacggtaaaatatcatcaggacgttctctttcactagtgaaatcatactttaaggagtttgtattagtacggtttattattgaatcaaaattagatttcatcattatcaccaaaagcctgcctcaaatcagctaataaatcatcaatattttctattcctactgataatcgcaaaaaattatctgtaattcctaatttagctctaatttctgctggaacatcaccatgggtttgaatcattggataagtaatcaatgactccacacctccaagactttctgcataagtaattaattgtacattttctaaaatcttttttgctaaaaaatgattttcaacactaaaggctatcatgctgccaaagccgcgggcttgatttctattgatttcatatcctggatgctctattaaaccaggataataaactttgctaacccgcggatgccgatttaaccagtttgaaattttcagcgcattttcttgttgcgatttttgtctgattgccagcgtcttgatcccccgaatcaataaataacaatctagtggtgacaagctatttccaactgtctttgaaacttctctaatccttttagctagtttatgatcaccagtcgaaatacttccagcaataatatcattatgcccacttagaaacttagtagcactatgaattacaatatcagcacctaataataatggattttgaaaatatggtgaaaggaaggtattatcaacaattagtaacagcttgtgggcttgacacaaggcactaattttttttaaatcacttatttgcattgttgggttactcggcgtttcaataaaaacagcttttgtttgaggacgaatatactgcttaaaactctttaaattagttgtatcaacataactgaattttaaacctttattttgctgcaaagtaaatagtcgagttgaaccgccatataaatcatttgaacatatcaaatgatcaccactactaaaaagttctagtaccaatgaaattgctgccattccactagaacaagcaactgtatcaactgcgccctctaaattggaaataatctcttctaaataagctcttgttggattactttcacgagagtagttatgccctctgctttccccaatcccaggatgagaaaaaattgctgtttggtatattggaattgaaacagcaccataaggatgctgtttcaattctaaatttgcaggatgaatacaacgagtttcaaattcatatttcatacttttctccatttccccacgctaagcgcatggacacaaatatttcttgaaagacattctgattccttctactctactaccccctgctataatgaaagggaggtagtatactacagagcacgagaagtagagtaggtaattctactcgttagaatatcttgtataattataagtcgccgtcatcttttcgagcacaaataattaggactcagagcctggacacttattattgatatattaccaatttggtcatattgctagatgacagtcagtaccacttcttctttctttgaaaggaggttttattttttgtagcggccatcgctgcttctggtgataataatgtcacgacctatattcaaaagcagttttctacttttaactctgatttgttgaatcttttaaactggcttaaatcaaacaactgttttgatgtttgcatggaatctaccagtaagtactggattcctgtctttaatatccttgaatctgaactcaatatttttcttactcatcctaaatacgtgaaggtgattagaagtaagaaaaccgataagaaagattcaaaatggattgctaacatctttaaacaagatcttctcaagtactcttttattccacctaaaaacattagagaacttagaaaaatatcacattatcgcattaaacttgtcaataagcgctcttctgaacgcaatcgttatcaaaactgtatgactgtttctaatattgccttagcttctgtctctactgatcatttaggaaagaattgtaaagctgccatggatgagattctcaaaagtgatattatcactgaagacaatcttaagaaaattctcaagggttctgtttcaaagaaatctgatcaaatttttcaagccattcagaattctcacattgaatctgaccaaagattcaaaatcaactgcactataaaacacatgaataatcttgacgaatatattcaaaactggttagtatttgaaaccacttcttgttcaatgtgctctttcggctatcaagagtgaaaaagaaacatatttcagaatcaagtataatcgtattaagaaacgacgtggtcataagaaagctattatagcgaccgctagaatgattcttatttctatataccatatgacaaaaactggtgaaaacttcaatccatctgattatgaatcattaaaaaatccaaaaccaggcaaccagaagataaccactcatcaagcattagaattattgaaatccatggatattgatataagccaaatcaatttatcttctattcaacaaacgagttcatcatgaatttttaattttttaggtcggctttttttataaatttctttcacacttatccccttttaattatagctaggtacataccataaaccattattatttttatctaaatattctttaaattcttttgaacgataagcttcaacaattgctttagcccattttgtatctttatttttttcttttacaactacttgtaacaataaatgttctaaaacatcctcctgtaataacgcactcgaagcatcaattcctgcattataaactatgctgccggtgattacagcataatcaaactcatctaaagcttgaggaatcattgttgaatccatttctgtaaactctatttcataaggatttttaataatatcatcttttgtcacggaactaatatccacatctggatctaaagtaatatactttgctttttgtaataaaacatatgctctagatgtatttgaagcatcgtttggtacagcaatcttagcgccctttttaatttcctctaagcttttatgagtatttgagaaaattcctgcaggtacagttggaattgctgtcaaagctactaaatcaccatcttgtgattcattaaaatttttcatgtaagctgtatgctgctcaacattgacatctatctcgccttcatttaaggctgtatcattttgcaataaatctgaaaattcgatgcatttaaattgataaccttcttttttcaaaattggaataatggcatcttcaaataagactgtatatggccccgctgccttaccatagataattgttgtcttatcttcacttttatcactactactttggcatccggccaaaacaaaaaccatcactaataataaactcaatattctctttttcatttttcttcccctattcatgtgttctaatttttttagataaatgatttcccaatgtttgaattaattgtacaaagataattaaaatgattacggtaacaaacattagagtattattaaaacgctgataaccataagttaatgctaaatcaccaacaccaccgccgccgattgttccagccatagcagttgcccccaataaaccgatcgttccagtagtaagtgctaaaactaacgaagctttcgcctctggtaataaaaaataacgaatgatttccaaagtatttgcccccattgctttagcagcttctaaaattcccggttgaacttctaatatagaactttctatcaaacgagccaaatatggtgcaatataaaatactaatggaacaattgcagcctttgttcctattcttgttccaaccagcacttttgttagcggagcaataaatactaataagattacaaatggcacagatctaacaatatttactaacccactcacaagaaaatgaattgtatgattggctttaactccattttttctagtaaggactaaaagtaagcctagcggtattcctatcaaggttccaaaaaataatgatattcccaacatataaattgtctggcctgccgcttcaagtaatttatcagcaggtatatttaaataattttcaatcataattcaattccaccctctctatcttcacatcttgtttttgaatataatttatcgctcgaataacttcatcctgttcaccttttaactgaattgttaaaattcctaaaatatcttctcctacttcattaactgaagcaaataaaattgttgttataattttaaaatgcttattaattttagaaattacatcatgctttgtactttcaccaaaaaaagtaagttttaaaaccggataccgataatctaattcttttaaaagtgtggttggaattacattgctaataactgtttcaacaaatctctttgtcatttcttgttgtggattactaaaaacctctaaagtatcacctttctcaatgattttaccagatttcattaccgctactttattacaaattttcttgattacattcatctcatgagttattaacaaaattgttatcccaagttcacaattaatttttttaagcagcaataaaattgcttctgttgtctgtggatctaaagcactagttgcctcatcacagagtaaaatcttaggttctgtagctaatgctctagcaataccaattctttgtttttgacccccagacagttgtgatacataagtatcacgcttatcttccaattccacaaaagataataattgtttaactcttacttcaatagcttttttatccagttttgaaagaatcaatgggatagcaatgttttgatagactgtttgtgattctaataaattaaactgttgaaaaatcatacctatatcttttcgtaaaatatttaattctcgttcttttaaatctataatattttgattattaatatagattgccccattttcaggacgttccaataaatttaccattcgtaataacgttgatttaccagccccagaataaccgattacaccgtaaatatcacccgcttctacttctagagagacatcttgcaatgctggaacttcaccacttttagttgtaaaagtcttatttacgtgttcaattttaatcattctcatctgcctccaattttaaaagagcctgtttcgccaattggctaagatattttgcagctaacgataaagctgcaggatttaccttaaacttcggatgatgattaggataggtctttccggttccgattttaataaatgttcccctgattttttcaagataaaatgcaaaatcttcgcctcctaaagttgcttcgggtatccctatagcaattttttctgcttgagcaattgctttagcaaaattactccattcctcatcattgacggttgcaggaggccccgctatccactcaatttctgtatcaagatcataggcttggctaatcccataagttatttcctttaatcgttttccaaacagctccctctcctcgctagtcagcgttctaacagtcccttcaattaaggcttgttcaggaataacattccacgtattccctgcttgaagatgtgtaatacttaaaacactactattaaaaggatccatatttcgactaacgatcgtttgtaagctgttaactaatgcagcagctgcaacgattggatctttagccatttgtggatgggctgcatggcttccaaagcccttcaaattaattttaaatcgatcaacagcagctgaaactgtccccgctttaattccaattgttcccacttcaaactgcgaagtactatgaattccaaaaattgcattaacatcatctaaaacccctgtctcaataatttttagagctcctaatgaagactcttcagccggttgaaataataattttactgttccatgtaattgagcagcattttcatttaacaataaagcaacaccataaatcgttgttaaatgaaaatcatgaccacaagcatgcatctttccttcaatctctgacttatagcttaatgtcgtttcctcattaactggtaaagcatcaatatcacttcgtaaagcaattactttaccagggtatccacctctaataactgcaactaatccagtttttaatggtaaatctaaaacttcaatatcatgctcttgtaataatgttttaattcttttagtagtttcatattcctcataagataattccggattacgatgaaaccactcaaattgatattctaattctttttgtaaactgtcgtcttccattctaattccccctttttaataacaaaagtgggatgtttatgtaaacatcccactaccccatttaatatagtattaagaatatttgcatacacgaaaatgtaccctatacttttgtatacagctgcacatacacatatacatcatatctcttctgctttttaacatcatcgttcgctcctcttcttttcctactatatcgataggtttgctatgtaaagtatcttaacacactataaatactccgtcaagcaaaaaaataaatgtcaatatgtttgcataaaaaaaatagctaattagctattcttcgttgatataaataaactcctaaagcagcaccaataataatgatatatccaactatgctccatatatcaggaatttgatttaagaaaataaatcctaatatcgctgcaaataatatttgactataatcatagattgaaatatccttgccagctgcattattatacgccgcagtaattgcaaattgaccaccagctgccattaaccctgcacctagtaagattaaaaactgttctaaactcatcggctgataattaattattaaatatggtaacacactgagacaagaaaagcatgaaaagaaaaatacaatttttgcaccatttaccccctgcttacctagcttccgcacacaagtataagctattcctgctcctaatgcccccaaaacaccaataattgaatccacattatttaaaagattaaaagatggtttgattacaaacaagcttccaatgaaagctacgataattgatattttttgtattcttgtcgctttttcttttaaaaacaaagaggaacaaataattacaaaaaatggtgataatttattaagcatcgaagcatcactaactaaaagatgatcaactgcataaaaattacaaagaattcccaacgttccaaagactgagcgtaataaaagcatcggtaaatctttttgtttatatgtaaatccctgtttactttttaataggataaaaaaagcaaataaagcagctaccaaatttctaaaaaaacttttttgaattgatggtaaatcgccagctaattttacaaatacattcattgctgcaaaaaagaaagcggctaaaattatacacatcatccctttacggatattattcataagcacctccagatactataatgattatatctattataaccattacgtcaattaatatgatttacaacaaaaaggataactttcgttatccaattaattattattgaacagcaaatataagttcagctttacaaactaccttaccatttaccttagcaacagcatcaccaattccaattggtcctttttgtttagttagagtacattccatttctaaaacatcaccaggcgttacttgacctttaaacttacacttattaatgcccccaaagaaagcaattttacctttattttcttctttagaaagaattgcaatacacccaacttgagctaatgcctcaacaatcaatactcctggcataacatgatgctcaggaaaatgaccacaaaaatgcatttcattaacactgacacatttaattccttttgcccactgtccaggctggtaatcagtaattcgatctactaaagcaaaaggataacggtgcggattgatttcttgaatttgattactatttagttccattttcttattctccatatttcttaaagatgatagtcgcattatgaccaccaaatcctaatgaatttgacatagctacattaacatcttgatttctaccagtatttggaacgatatctaaatcacataatggatctggtttttgataattaatcgtagctggaataaatccctcttcgattgctttaacacaaattaccccctcgattcccccggcagcacctaaacaatgccccgtatttcctttcgtcgaagaaatagcaacctttttagcagcttcacctaaagcagatttaattgccattgtttcacctttatcatttaaaggggtactagttccatgtgcattaatataagttacgtcttcagctactaaaccagcatccttgattgcattgatcatcgctttagccccaccagagccatcttctaaaggtgcagtaatatgatgagcatcacaactgacaccatatccgaccatttcacaatagatatgagcgccacgagctttagcatgttctaattcttcaagtacaacaattccagcaccctcacccataacaaatccacaacgttcctcgtcaaaaggaattgacgcccgtttcggatcattattatcacaaagagctttcattgatgaaaagcctccaataccaagtggagtaatactagcttctgccccaccagcaaccataatttcttgataaccatcacggatatttctaaacgcatcaccaatcgcattagttccaccagcgcaagctgtgaccggacaagtacataatccttttgcccctaattcaattgcaatatttcccgctgccaaatttgtaattgacattggcacaaagaatggcgaaacacgatcataacctttttctaaccccttagtatgatctttctcaattgttgcaagccctccaattccgcttgacacaactacaccaaaacggtcagcatcaatctcttcaatctttaaaccagcatccttaaaagcctctttagcagcaattacaccaaattgagtaaagcgatccatttttcgaactgcttttttatctaaataatcagcagcattaaaattttttacttcacctgcaatttttacttttgttaattctttatcatagtttgtgatttcgtcaattccacaaacaccttctttaatacttttccaagtttcttcaacattatgaccaattgcattaattgctccaagccctgttactacaactcttcttctttccattgtctctctccttacattgccattccgccatcaacatggatagtttgaccagtaatgtatctagcatcatcacttgctaaaaatactaccgtattagcgatatctcttacttgtccaaaagttcctaaaggaatttgtttagccatactttctttaatatcttcaggtaaaacatcagtcattgcagtttgaataaaacctggtgctaccgcattcacagtaattccccgactaccaacttcgcgcgctaatgacattgtcattccaataattccagctttacttgctgaataatttacttgaccagcatttcccattaccccaactactgatgacattgaaataatacgaccataacgttgtttcatcataattttagtcgcatgtttcatacaattccatgttccttttaaattaacatcaataactgcatcaaaatcattctctttcattcgcatcaacaatccatctttagtaattccagcattatttacaagaacatcgattcgaccaaattctttaatgatttctttaaacattgtttctgtttcttcaaacgaagcaacattagcttgagctaacataacagtcgcaccgattgcttctaattctgatttagttgcttcagcaatttttttattatcaccaaaattaacataatttacaatgatcttagcaccttcacgagcacaagttaaacaaatttctttaccaattccttgggctccaccagttactaaaactactttatcttttaatttcatcttattctccttttaatcccgctaatgttttttctaatgatgcttgatcttcaacttgataagttttaattgtcttatcaatcttacgaataaatccacttaaaactttaccaggaccgatttcaataattgtatcaaccccgttttctaacatataacgaatactatcttcaaaatatactgaagacattacttgcttctctaacatttgagcaatactaactccagactcaagttctttagccgaactattgaatattacaggaacttgcatttcattaaaattaacacttacaaacttttctttaagttcattactagctggtgctaataattctgtatggaaaggtccacttgtatttaaaggaattgcccgacgagcacctttttctaatgctaattcgctagccttagtaactgcctcagcctcaccaccaattactaattgtcctggacaattatagttagcaattgaaacaactcccaaagccctagcttctttaactgcttcatttaataattcgcgatctaagccaataattgcaatcattttgctttcaattcctgctgccgctctttccatcgcttgaccacggaaacgtactaaattaattgctgtttgatcatctaaaacacctgctgcatttaaagctgaatattcaccaagacttaatcctgctacataatctggagcaattccattttcttttaatagcttagttgctactacagcaacagcaaccatacatggttgtgtatttcttgttaaagaaagttcttcaaggggaccttcaaagcataatttctttacatcaatatctaagtcaatgttatcaaaaacatctttagcaatttgatagttatcatagaatgattgacccattccaactacctgactaccttgaccagcatatacaaatccaatcttacccattattttagtcctctctttaattcatccattaattcttttactgaaataattttatcattacgatatccattgcttccactaaatactaatccctcatccaaattacctttagcagcattgatcaatgcaccactaatacaataaggcgtagttttaacatcacaaggaattaagcaattataacagcgttttactggaatcctttcatcttgtttaagtctttttgtcaacttcgtcatgatggctcttcccggcattccaactggtgatttaacaatctcgatatctccttttttagcatttataaatgcttgtttatatttaatatctgcatcacattcctcagtacaaataaaccgtgttgccatttgaacaccatcagcacctaaatctaaatacttttgaatatcctcactatcataaacaccaccagctacaaaaataggaatatccttttgatatttttcaacaaatggttgaacagtctcttttacttctttaaaaatatctactaatttagccgttgttttatttaacacatcttctttatgaaagcctagatgaccaccagcttcacttccttcaatgacaacaaagtctggagctaccttaaatttacgatcccaagttttacaaatcaatttagcggctttaccacttgatacaattggggcaattttaacttttgttccttgaacaaaacttggtaagttcataggtaatccagcacccgaaataattgcatctattttactttttacagctacttcaactaaagctgcatagtcagtaattgcgaccattgcattaattgcaaccatccctttacctttagcaatctctttagctttctttatttcattagctagctcacgtttattagcttctagcggatttttttcaaaatcatcagcacgataaccaggatgagcagttgaaataacacccataccaccatttaaagcaacatttccagccaaatttccaagtgaaataccaactcccatgccaccttgtatgattggtacatcaagagtcatatctccgatatttacctttttcataattaaaactcgctttctaatttcttaaatgccttatcacaatcatcaaataattctttaataattacttttagaggtctaatttcattgatcattccgactacttggccagccattaatgaaccggtatcggcgtcaccttctaaaactgctctacgtagtgaacctaatgtatatttttcaagttccatcatgtcagcaccttctttttcacgcttaacatactctttagccattttattttttattacccgtactggtgttcctgcgattcttccagttactgtagtgcttgtatctttagctttgattacagcttgtttataattttcatgaatcggacactcttcgcttgcaagcagacaagttcctacctgtactccacaagcccctagagcatacgctgccaatacctgttttccactcgcaattccaccagctgctataacaggaacactaactgcttcaactacttgaggtactaatgccattgtagttaattcacctatatgaccacctgcctcagttccttcaacaataattgcatcaacgttatatttttcaaggcgctttgctaaagctacacttggaacaactggcaatactttaattcctgctgctttccatgcagcaacatatttaccaggatttcctgctccagttgttacgaccggcactttttcatcaattactaattgtgccatctcatcagcacaaggattaatcaacatgatattgacaccaaaaggtttatcagttaaattacggcaaatttcaatattcttttttaatgtagcagtgtccattccaccggcaccaattaaaccaagtgcgccagcattagatacactagctgcaaattcaccggtagcgatatttgccattcctccttgaatcaaaggatattcaatatttaataatttatttaatttcatcttctaactccattccattaatgttgcgccccaagtaagaccaccaccaaaaccaacacaaataattttgtcacctggtcttaacattcctttttcattcatttcacctaaagccaaaggaatgctagctgctgatgtattcccatattcttgcaaattcatataaaacttatcttctgaagacttcatcttcttatatacatttttaataatccgataatttgcttgatgacagacaacgtaatcaatctcatcaagagttaaatttgttttttctaagattgcattaatactttcaggaattacttttattgcaaacttaaacacttcctgcccagccatcgttaaataatgatcctgattagatttactgattgccggggcctttaatgcttctaaatttcccgctgaattactgtagctagcaaaaataccatcaccatttccaactacaagggctccagccccatcaccaaacaaaacacaagtattgcgatctttgaaatccattattttggaaatttcttcacttccaatgactaaagcatatttatcttccatgttttgtaataatgcctgggctaccgttaaggcatacacaaagccgctacaagcagcatttaaatcaaagcacattacttcttgatcattcaaacctaatctttcttgaatcaaacaagcagtgctgggagtaaaataatcgggtgtcattgttgcacagataatcaatccaatcttacttttatctattttttcaactgcctttaaagctgcttgatacccaagttctacgcaactttcattttcagcaatatgtcttctttttatcccggttctagagacgatccactcatctgatgtttcaaccactttttcaaggtcgaaattatcaagtactttttgtggtgcataataaccagttgataatatttttaatccactcatataatctcctaatatttttctttgatatcttcaaagaaatacaataactgttgtaatgatttaatcagtaactcatcatcaagaacatgactatcttcacagacacgacttaccatctcttcgtgaaagtctcgatgtactttgcaaacacgattgcctttagctgtcagctctacacgaataatgcgtcgatcattatcatctttacgacgttttacgtatcccttagcttcgagcttttttattgctgtcgtaattgttccattagttaaagtcgcctgagaagcaattgttgacatcgtgggatttgaaagcgaactgattgcatcgataatatgcagttctgataaacttaaatcttccactccatgtcctaccatatattgggtttcaatatccaaaatttgattaaacagtcttacaaacagttgattaattaattctcgatttaaaatatcgcgattagtcattcgtaattcgacccatttctctaaatttattgtaacgtttatttactaatgatgtttttgataatttcatcaattcttcaagagtatttcgaagatagattcttaaacgtttgtatacatattcgcggttctttgtaattccacctcgaggttctttgatgatcttatcaatgatcttcatttcatataaatcatttgcagtcaatttcattagctctgcagcttcatgaactcttgaaccatctttatctttccataagattgatgcaaagccttctggtgataaaaccgaataaacactattttcaagcattaccatacgatctccaacacttagtgccaaagctccaccactgccgccttcaccgattacaatcacaataataggcaccgtcagctgtgacatttccattagattacgcgcaattgcttcaccgattccatgtttttcagcttttaaacccggataagcacctggtgtatctacaaatgtaacaattggtcgattaaatttttccgcctgtttcatcaaacgcatcgctttacgatacccttctggtgaagacattccaaaattacagtgtagattttcctctaaagttcgtccttttaaatgtccaattacagtacagggaatattattaaacattgctaatccaccgacaattgaaccatcatctttgtaaagacggtccccatgtaattcaataaaatcatcaaataaattatcaatatattcacggacattaggacggtcagctttacgagcaagataaactcgatcataagcactaatatcctgatatgcttcagcttcaatttttgcttttgtattttctaaatcttgaatttgtaaagtgtggtcaatctcttggtcatcctttaattttaataactctaattctatttctttaatttttatttctttttcttgcagtgacattattgcgcccccctgctatgcatttttaataatttgataatcgtttcacgcattttagaacgttctacgatcatatcaataaatccttgatcttgcataaactcggttctttgaaaaccttcgggtaatttttgtttaattgttgattcaattactcttggtcccgcaaatccgattaatgctttaggttccccaataataatgtccccaagcatggcaaaagaagcagtaactccaccagtagtaggatgagtaatatacgaaatatataacaatccggcttcatgatgtttggctagagcagcactagttttagccatttgcattagtgaaataattccctcttgcattctagctcccccagaagttgtaaaaataatgattggacatttgcgttttgtcgcatgttcaattgctctagtaatcttttctccgacagcacctgacatactccccattaaaaaacgagaatccatcacacaaacaacaacttttcttccatcaattcttcctgtagcacaaacaaccgcttcgtcaagatttgttgtttcttctaattttactaatttttctttataaccaggaaacattaatggatcatttgatttaatacttttatataattctttatattttcccccatcatacaaaagatttaatcgcgtgtatgcccgcatctttaaatgtgctccacatttaggacaaacataataactttctttcaaatcttcacttaaaatcgactctccgcaagaatcacactttgtatataaaccatcgggtacatcaattctttttttatcttgcattttattacgaatagatttaaataaattcaatttttcttttcgtgccttaaataactcttccatttattatcccaccaacttatctaagttattttcaataaaacttgtatcaaaatttccttttacatactctcccgtatgtaaaatcaaatattgtaattcttggttagtatcaattccgtcaataactaattcagctaaaactctacgcattcttctaattgcttctaagcgattagaaccatgaacaataactttagcaatcatggaatcataatgtgatgaaactttatacccctgatataaagttgtatcaattctcacccctaaacctcctggtaaatgaacactattaacagttcccggacacggtctgaatccctcacgtggattttcagcattgattcggcattcaatcgcatgtccatttaaatgaatatcactttgtttataagttaatttttgatttgcggcaattctaatctgttccctaattaaatctaccccggtcaccatttcagtaattggatgctcaacttgaattcgagtattcatttcaataaaataataatttccatcttgatctaaaacatattcaatcgttcctgcattgcgataacctgctcctttagccgctttaactgcatcttcccccattttttgtcggagcagcggtgttaaggctttacttggtgcctcttcaatcatcttctgattgcgtcgttgaatagaacaatcgcgttctcctaaatgaataacatttccataattatcggctaaaatttgaaattcaatatgtttaggatttaaaattaatttttctaaatacatatcatcatcaccaaaacatgctttagcttctgctttagcagttaaataagcatcatcaaattcttcttcgctaaaggcttttcgcattccacgaccaccaccacctgctgaggctttaattaaaactggataaccaatttgatttgcaacttctttagcttcttgtaaagtatttacactcccatcactcccaggaactaccggcacacctgcttcaatcattttttgacgggccatacttttatttcccatcatatcaataacatcgccactaggcccaataaaagttattccacattcttctactaaacgagcaaaagttgagttttctgataaaaagccaaatcctggatgaattgcatcacaacctagtgcagtcgctacacttaaaatatttttcatatttaaataactatccgctgccttggcaggacctatacataccgcatgatcagccaattgcacatgcaatgaagtactatcaacatttgaataaacagcaactgcttcaattcctaattcttggcatgttcgaattattcttaccgcgatttcgccacggttggcaattaaaattcgcttaaacatcttaactacccttcaatgatcattaacacttgatcaaattcaactaaatcttcagtatttgccatgattgatgttactgttccatcaattggagctttaatttcattcattaccttcattgcttcaacaatacacaacacctgtcctgcttttactttagtgcctacttctacatacggtttagcagttggtgaactagatgcataataaaccccaacaattggtgatttaaccggtgttccggtgattgctggttcattagctgctacttgctccactggcgctaaagtaggcgttggagcagaaactaccggtgtacttacaacatttaccggtgctactggcgttttttctaattctaatttaatatcatctatctctactttcattttaaaaacttctgagttttcaaattcatttataagttgctttactaaatctattttcataaatactctcctttattttgaatatcaaagtaattttttaaaaaaattattacccagctattctgggtaataaaaatcagcatttattatgcattttctttgatataatctacgatatcttgaactgttttaatttcagctgctttatcatcagggatttcaatatcaaattcttcttcaactgccatgattaattcaactgcatctaatgaatctgcatctaagtcttcttttaagttagcttctaaagttactgcatcttcatcacagcttaaagaatcaacaattatttcttttactttttcaaattccacgttatattcctcctcgtgtatattacggtcacattataacaaaatcaaaacatttgtaaatagtttgatgttcaaaacttttatcgaagactgtcgaattaacccaaaacctagtaaaatcaaggtgtttcaagtaatatttttttcgttttttttatgttttaatcgtcatttttttatgttatagtcttttttaggagggcacaattaatgaaaatacccgaaataaaagctaagacaatcattcaaaacaaagccgataaaaatcatttttggtttggttttgactacaacatgaatctctaccaaggatgtcatcacggttgtatttattgtgacagtcgtagtgattgttatcaaatctcaaactttgatcaaattaaagtaaaacataacgtactcaccctactttctaaagaactttgttctaaaaaaagaaaaggggtgattgcaattggagccatgtctgatccctataatcattatgaacaacaattaaagataactcatcaagctttaaaaataataaagcaaaccaattttggtgtaatgataacgactaaaagtcatacgctcattaacgatcttgaactcataaaacaaattaatgataaacaatctgtcctaatttgtatgaccattacttgtggtgatgattcattagcaaaattgatcgaaccaaatgtttcaatttcatcaaaacgatttgaaacaattaaacaattacgccaacacaatatttatgctggggttttaatgacaccgattttgccatttattaacgatacccctgaaaatattcgagaaatcatctatcgcgcacatttagccaatgccagctttgtttatcctatgtttggtgtgactttacgagatcatcaacgtgattatttctatacgcagctagatcatttatttcccggctgtaaggaacgctatataaaacaattcggtaatacttatttatgcaacagcccacgactttatgaattaaaaaatatatttattgaagaatgtcacaaatataatatcatttataagatggaagatattataaatggttataaacaaactgcatcatcggaacaattgagtttattttaaaaaatagtccagaagatcttctggactatttagcatgttcatatgtataattcattaccacttaatagataatactcatctttttttagtatcaatgttttgatagtctaaacgtttatacaaattatcaatatattggtgttttaaaacctcttgaaaactatatttaaaattcaaatcaaatacaaatactaaatgtggtaaccaaatatctaaatcattttgctgacagctgcttaaaatcatttcatgattcaaaaatgactggtacactgctctcactaatcaattgtttttctatttcttcttttcccttataataaattgtttctagcgggagagtagattaatttccagcttatcgattttgttagcatcacggataatctttgcatgcagtaattcatgagtatctaatcccattcaaatcacatatttattgtgctttatgattgctttataaataatttgctcattattataaatatcactaaatttttcaatcaacctatcttaaaataataaagagacatcgaaatcatattcactgacataagtattaaattctttatatgcatactctatttttatcattaacttacctcaaaaaagtgatcttaattattaagatcactcttttcttttaaatattcattagcatggttcattatatttaacatcttcttaaaagtatcactattttgataattaagtcgtttaactaattttgtaatataatcttgttgataaacataattacaactatactgataattcaaatcaaatatcaaggccaaaaaggatacccagcgatccaagtcagttttacgagtggtactaagaattgattcactattcataaatgtttcatatatcgattcagtaatgatgtcattttctaaaatctcttgtccagcatccaaaaatgcttcgaacgtttctaacaaacctgttttaaagatatcgattttgtcagcatcacgaattattttacagtggagcatctcatgttcacttaatccctcagcaattttatatttattatgattaaaaatagctttgtagatcagtggataatctttttgatcaatatcaaatttactaattaaattatcatcaaataaaatttgaacacctaataatgcatgatcaattgttttactatcaataaaacaattataacgttttaattgttcaaatctcccaatatcatgtaataatccaattaatgatgctaagtctatttcatcttgatctaacccgagactcactgcaacattttttgaggcctccataacacgataagtatgttctatctttaaggcaactttaggattatctttatcataattcgctacatattcatcaaacaatcttttagcattttttaaatctatcatctaaccacctccagctatcattatatgctctttaacagcatttctctactattttctaaatagtaatttctatttttatatggttatgttatattaataaacaaggatgtgattagatgaaattaagattaactactactaatgatttaaccgctgtcatgacaattatcaatcaagctaaagtatattttaaagagcaaggaatcaaccaatggcaagatggttatcctgatgaattaactattattaatgatattagccgccatgaagcttatgtgcttgaagataacggagaaatagtcgcaactgcgatgatctctaaagagcttgaacctagttataattatatagaagggaaatggcttcaagataatgcatacattgtagttcatcgcatcgcgatacgaaatgatcaaaaaggtaaaggcttggcaaaaatcattattgatgaaggattaaaactttatcctaaaaaaccaagtatccgtatggatactcatgatgataatctttcgatgcagcgtttcttgattaaatatggatttgaatattgtggcactatttatttagaaaataaagaaactcgacgagcatatgaaaaaattctttaacctgcattacaaagtgcaggttttattgttcaataaaatcaattaatacttgattaaaacgttctcgttcatcataaaaaatcccatgtccactatattcaaacttgcataaaatcgaatcttctatacattcatgcatgattaaagcaaacgaaaaaggacaaattttatcaagcactccatgcatgattaaagtagtgaccttaatctcaaacaaatcttgatacacatcttcatctcgtaaagaaattgctgtttggatcgttcctattcctgatccctttaaacaaattgatgtaaaccagttcataaattcactgccatgatttaatgcaaaaacattttgtccgaaatcatgaaccattttaggtcgattagtataacactgctcaatcagttgatttaccgcatcgatactttgtccttcgggattatgaattgtacgagtatatgaaggcactgcagcaccagccaaaactagtttacttactcgttcttttccaaatttactcatataacgaacacaaatcgccccacccattgaaaatcctactaatgtcacattatggacatttaaggttattaaaacactatgcagatctatcgctaattggtcataatcatagcccctgcccataacttgtgacattcctaatccacgaatatcataactaatgatgcggtatcgacaatcgtttaaaatatctttttgatattcatacatttcttggcaaattggccagccatgcactaaaactactgtcttttgatgagctggattaatatcctctaccgctaatttggcattatctgatgattttagataaaacacataatcccccctcatcatattctatgtaagctcaataatattataaccttattttaattattaatttttgtataccagcagtcgattaagttaatcaatatttactatgattcgctatcattaattttgataaattatattgtgatattggagtgagaatattaatatatatcatcagtgcaattattatctatgggtatagttgttattattttaccagtactatcgctaatcttttaattgcattaatagccttatgagtatttggtatatttatcatcggattaattttcttaaggaatgtccgcataaaaaataattatagtggtctcttgtaagttgaaacattccttattctcagcttgtttttaaatgattttaatagcttgagcgactataaccccattattctttttactaacagaaatattactatgacatataatatttctgttagtaacttgataattacaataattttgactattatcttagttattttcaatatttatatctttaagtgtaaaaattatttcatttgtattcatatcttattgtattcagcatatttttatatgaggtgaagaacatggatactaaagtaaataagccttaccccgaaataaaagtaactgtgccaaatgaaacttatggtttaatgatccttgataatgtcggtgggatgaattctgaaacatctgcaatttgtcaatatatttataaccatagtattgctggcgaagattttttagaactaaaaaaaacatttttaaatatttctatggtcgagatgcatcatttagacatcttcatgacccttgccttagaattaggtttagacccccgctggtggagctgtctaaatgatcaatgtacttattggtcaccatcatatttaaattatcctaattcactagaggaagtactaaaaacagcaatagacgctgaatatcaggcaattgataagtatatgtatcaagctagcatcatcaaagatccctatattgttgcgattttaaatcgaatcattgaagatgaagaactgcatatcaaggttttaaaagaatgggaaactaaattagttagataatctaactaattagttttccttcttttaataattgcaataattgtaaattttgcgccgcactacctacataattagtaattccattaagttttgctaaatgttgacgattttcaaaacttgtatcaacattaatttgctgaagggctccaactaaactatctccaacataattaggatttgacaaatagcttaccctaccttcaattacctggtcattgacccagccttgatcattacctattaaataaggatttcgagtattttttacaattcgagttatctttccaacattacgatatggccgtaacggattagaagattcactagttaaaaagacatagctaaatcttactgtatcacctaatttatattgttccactgctgtatcaatatcaaaattattcttacctgcacgtttaataatagctggaaaatcagcataacaataattcatatcaacaattgttggtaccccttgaacccatccagtcgaactatattgccacatatcatacggtttatcataatttaactcagcagcatagttagcaacccaccgtgtataattatcaaaaatcggatccgttaatttagtgttccaccagtatagtgaagcatacatcccaacataatatccattggcttctaattcatcagcaaatgttttagcgatatttgcaatcacatcatttgattgctttccagtcgtattattatcttctaaatcataatacactggatatgccatcttatagtttttcactagacgtaaaacatgttgtgcttcccctctagcatcactactatttttagcatatgaatataagtaaacaccaaacggtattcctaatcgtgtacactcgtctgcatttcttttaaacaaacgatcatcttgatctgttcgatcttgaccaaaaccacatctaagaattgcaaaatcaactcgatcttgaacaatttcccaatcaattaccccctgatattgtgagacatcaattccatgtgtcgtcattcttccacctccattaataatatatgagcaattgtcaaaaatgtgtgactttctagacttttttatcattttaatgcgaaacaatgaatattatgttataatcacattggtatggattaaatacgccatctttaaaactgaatataaaactaaataatatatataaattggaggtcgatgaaatgaaaaaagtattcgtcactgctttaggagtctgtacaatgctttcattagtaactattcccactcctgttcaggcaactgatttttccgggcaagaagataagtacatgaaattatgctcatcttcaaatctttcaactaataacttgaacacttgtaaagaattcaatacatacttgaaaaataaaaataaagaattgaaatctcaagtaagtgattcaaaaagcaaagtatctgatactcaaaatagtttgaatagtatctcaagtgaaattagtgcattaaatgatcaaattgctgaaaaacaaaaagaaattgaatatttacaaacttcaatttcaaatttagaagcaagtatagctaaaaaagaagaagaagtaaaagaacgtatgtattcaatgcaatcatacaataacaataattcatatattgactttatctttggggcttctagcttcactgatatgtttgcccgaattgacagcgttaatgaaataacatcgtatgatgatgaattagttgcacaactagctgatgaaaaagaacaagtagaaacacaaaaagctacggttgttactgccaaagctaatattgaaagtcaaaaatcatcaaagcaggcactacaacaagaatatcaagctctatttgaaaaacaaaacgctgatttgattgcgcaagaaaaagcagctgctcaagcggccgattcaagtcaaaaaatcactgataatatcgctgcactattagctgctactgaaaaatcacaagtttctggcggaagcgttgtttctggtgattctgcagttggaaacgcaattgcacaaaaggctttaactcgcgttggttatatgtatgtatggggtggatgtcacagcatgtctgaaatcgctaatccaaaccacactgcatttgactgctcaggtttagtcaactgggcttattatcaatcaggtgtcaacattggttctaataataccaaatcgctagctagtaaaggggtatctgtttctcgtaataacatgcaggccggagatatcatcttatttagcagtaatggaagtaccagcggaattcaccatgtcggtatttatatcggtggtggtaacatggttcatgctccacaaacaggtaaacctgttcaagtagcggatcttggttattcatattggcaaaaagaatggtatgacgttcgtagattgtattaatacaattagatgagcaagcttgctcatcttttttatcacatatatatgaaattcataaattaatttcattatttccataacaaatgtgatattttttagaaaattagctttatatccttagaaaaaatctaaattagtatttacttattaagaaaaatataggataattactatgtatcgaggtgattgtatgaaaataaaaaaagttatatctacagctttaacgctgacaatagtaacaagtgcatgttattatgcagcccctgtggcagccgatgaatttgatggtaatgaaagtaaatatatgacattatgctcatcttcgaatttatctagtagtaacaaatcaacttgtgaagcattcaacaagtatcttaaaactaaaaattctgaattaactaaaaaattggccgaacaaaaagaggctgctagtgacactaaaacaacactagaaagcgttcaaaaacaattagatgaagttaataaacaaatcagcgataaagaagctgaaattgagtatttaaatacaactattgccaatcttcaagcaagtattgaaaagaatactcaattattaaaagatcgtatgtatgcaatgcaatcttatgcaaatgaaaatacatatattaactttatttttggtgcaagcaacttcacggaaatgttctcaagaatcgacggttataacgaacttacacaaagtgataaagagttgattgaagaacttaataaacaaagaaaagaagttgaacaacaacaaactattttagaagaagctaaagccactttagttattcagcaagaagaacaaaaaacattaaaaacaaaatatacagctttgttagaggaacaaaacaaatcaattgcatctactcaaaacacgatttatgattatggtgaaatgactgaaaccctggatgctgcaattaaaaaatttaatgaagaagcatatgaaactccaactcctacaccaccgcctccaaaacctgataatggtggaaacaataataattccggtggtaacaacaacaataataacaacaacaataataacaatagcgattctggaaataacaacaatggcggaaacaataataatgattctagcacatcagataatcttggtgaaaaaatctatgctgctgcttatgctaaattaggatcgcgttattggtggggagctcaaggtcccacatactttgactgttctggtttagtatattggtcattaaaacaagcaggtgttagtggtggtcgagatactgctgctggttactccagaaaatggtcagctgtaagttttgcaaactctaaaactggtgatttagtatgttttggtagtccagcttatcatattggaatcattgttgtaaacagcgatggttccagatcaatggttcatgccggtggtggtgattcatcaacacacggtgataatccaaaagcttatgttaaagtatcttcaattgaaccaggatcatattactatagtagaataagtacaattagacgtgttagtaaataatagatattttaaaggacaaattttgtagttcactacaatacttgtccttttttattttaggcgataattatccaaataatatatgagcgttatgttatatttatatcctatttaaaatttactatgctataattaaagttagaaaacaaaggagggaaatgagcatgaaagcaaagataatatccctctttcattacttattagtctttttattaataatttttaataccagctgtcaagctaaatcaataaatattgttgatacaaataataatgatcagattgaactaaatttttatggatataaaacggaagcaattaatgttgttgcaatcgaagaaattttacaagcttatatggataaaaatcccaatattaccattacctatgaaagtgtgaaaggaactgagtattatgagatactaaaaaaacgtttggcctctaataactatgatgacatttttatgatcgatgaagataatttacagcaattaactaattataattattttgaagatttatcaaagctaaaaacaataaaaaactttaacacaaactcattggaacaaatggtgcaaccagataatacgatcccctatattccaacttctatttcagcatttggattatattgcaatcttgatttactagaaaaacatcatcagtcagttcctaaaaataatcaagaatttatggctgtttgtcaatattttattgagcaaggaattactccgatcatcgctaataatgatatttctctaaaaacaattgctcttgctaaaggtctttatcccatctatcaatcacctgaaaaggatagaataatcgcttcactaaatcaagatcctagcattctttgtaattatcttaaagaaggatatcaatatgttaaacagttaatcgacaataaattcattgatgcagccacaactttaaaaacagaaaaaactgcagacgatctaatacagtttgaagaaaataaaaacccttttatgttaactggtgcctgggcctctgttcgagttgaaaaaagttcaccagatttaaattttaaagtttacccttatccaattttagacgatggagcaattctagtttcaaatattgatacccgtgtatgtattaatgctaaaggtccacatattactgaagcaaaaaaatttattgaatatttaagtcaagaagatgtgatgtggaaatttgtaaatagtcagtcctcttttagtcctctgaaagaacaacgtattgctgatgatcctaagattcaagaattaagcccttatttaacctcagagaaaacaattctaggtagtgattcaaatataaatcttcccctttggtcacttacccatgaaggaatcacccaattattaacaggaaacagtattgatagtgcattagaaataatcaaaaattatgaacagtgaggatgattccaatgaaaaataaaaaaatatcgttaatgattgtcgggggaattagtgctgtgatttttgttgttttttccatgttcatttatgttaattatgttcaagattctctttgggataagtcaatcaatgatattttagaaacaacctctcaggaggaaaaagcctttaatgtctatatgactaaagaaatgactaactcccaaaacatccttactaatattgcctatctacaaactaagattccgcagtatctccagcatctatctaatcgtgaagaagctaaatatttatatatcgactataccaatgactgctactatgatgaaaatggtaattatccgttaggtgatgaacagttgtttcagcaaataaaagctgataataattcacaaggatttttagagccctatcttaattcaaaaacaggtattaagacttttgcaacttatgtaaaaacaagcgatagtcaaagtgtcattgtcaaagaaactcaattaagttttattattgaaaacttctcactttcgttttataacgatttaggtttttcatatattgttaaagataatggtgaaattttaattcgttccaaacatcgtaactcaaatcgtacttttaaaaacttatttgatttaatcgatctgtctggtaatgatgcaaaaaccattgaatcatttaaagcatctttatctaaaagagataaaggtgttgccttatttaattatcaagatagttccaatgtattttgctatgttccattacaacaaaacaatcactggtttattatttcaattattcctaataatgtaatcatgaagcaggccaataacattattatttcctccataattttatgtagtggtattgctggtgcaatcagctgtgttgttttgctatatatccgtgatagccgtaaacacaaaagaatgttagagaacttagctttttatgatcatttgaccatgctctataattatcaaaagtttaaaacagagggggaaaaattatttttggaacgtaatcatactcttcttgcagttctgtatttagatattaatgactttaaaataattaatgaattatatggttataaatatggtgataagatcttaacgcagctggcaaatattttaaaaaaattggtcatagccccaggacttacgtgccgagtaaatgccgataattttttaatcatgcagtcatatcatgatagaaccgaactggaaaacttatgccaagaaatcaatcaaaaattttgtaatcttttagaatcacttgataataaaaataatactatagttaaaattggtatatgctgctatgaagatgatcaaacaatctcaggtattgatggtctaattgactgtagtcacctcgctttaaatgcatatatacctggccaaaccaataactattacttctataattctaaaatgcatgatcaaatgattagaaaagtagagattgaaaataacatggagtccgctttactgaataacgaatttacattctatctacaaccaaagtatgcgccaaatggacaagtcatgttaggagctgaagctctagttcgttggcttgagccatcaggaaatctcattatgcctggtgaattcattccaatctttgaacaaaatggctttattcttaaaatggatgaatatatatttgaaagtgtttgtaagtttctctatcaacgaattatcgaaaacctgccaaatgttcctatatcgattaatatttctagattacatctttatcaagatgactttattgaacgctacagtaaaataaaaaataaatatagtttacctgataaattagttgaattagaaataaccgaaaacattttacttgataatattgaaagaattagaaacattatcattgaactacaaaataatggctttacttgttcaatcgacgattttggttcaggttactcatcattaaattctttaaaagacttaccatttgaagtcataaaattagaccggcttttcttaatcaacagttatgatattcaaagaagtcaagaaatcatcaaagctattgttgaaatggctaaaactattaatattaaaacagttgctgaaggtgtcgaaaccccaagccaattggaatttttaaaaatgattgattgtgatatgatccaaggatatatcttttctaagccacgaccaatcaaagaatttgaacaactgcttataaatcaagaaaaataactttttaattagattcctatttttagagttgcagactcgaaagtaggaattttttaacattttcttagatatgcacccaaaaacagcgtattatctttatttattgagttagcaatatctcgctaaatatcatataacaattattctttccatagaaacattttttcaaaaaacgatcaataatactctttatctaataatattctaaaatttgatagtacaaagaaaacttgttttcaaaattattatcccttcattataattataaaaggtttactacatcataatatcatcaaatcaatctaataaaatattcgttattcatatcaataccatctttttcatcaaactgtatacttttctataactataacgtcaataatttttaatatttatattaaatagtctttaaaattagcagcttttaaagaccagatattttttattttaattgaaaacgataacattgatattagagatttaataatttttattttagtgctataatctacaagaaaagagggatagtgtgaagtatgtacatcaatttttaattattatgacaatctcatttattggggaattgttgggattgttattgccattgccaataccggcaagcgtttatggtttagcaataatgctaatttgtttatttactagagtaattaaattaaatcaaatcgaggaagtagctgattggctgatcttaatcatgcccgttttatttgttccttctgctgttagtctaatcaacgttggtaatgctattattaaagatctcctagttattggaattgtcactttaattagtaccatcgttgttatgatcgttacaggaaaagttgcacaagtaatcattgaacgaaaggaggataatgataatggatagttttttgcttgaaacagtatattttgggattgttatcagtctattatcatattggattgcagttcaaataagaaaattattgccctacccaatttttaatcctttattgatcagtgctgttatttcaattggtatattaatcatttttgatattgattttgatacatataataagggagctcaattcattacttttttattgaccccagctactgtttgtttggcggtaccactttataaacaagtgcaaatattaattaaacatttagatgctattttaatcagtttatttagtggttgtcttgccggaattgtttccatttttataatgtgtttaattatgaaagccgatcctgtaatttattattcacttttaccaaaatcaattacaacagcaatcgcaattggtgtttctgataaactaggcggtaattcaaccattacagttggaattgttattattactggtatccttggtgctatcattgctaaaagtatttgtaaattatttaaaattaagcatcctgttgcaatcggtttagcccttggtaatagtgcccatgcgattggaacatcaaaagctttagaatttggagaaattgaaggagctatgagtagtttatcaattgttattgctggattattaactgtaatcattgcaccattaatggcaaatttattataaaaaataaccctttattcaaataaaatgatatgtactggataatccatatcaaaacgagtaaagggatttctttttattatatctgactatatatctctggactttctaagcgctcaaccaaacgctgtaatgattgctcaaaccgatcagtaaatggttcatcaaaataaagataaccattttcatagtcctcatctacagctgtttcaacaactacagtaagactttgataaacgctactaagattttcttttatatattttaattcctgatgattgtattcttcaataaaaatataatgattacaaacctctaatgcatatttaagttcatcattaaaattatctttaataatttcatgattaagaattccaacttgaaacccacgaatctctaattctaaagcaaattcatttatccacattatattacttgtattagttaataaagtaatatttttttctttattttttaaagttagattttttaaatcaaaaaaaacttgaagtaaatgccgaaccaaattacattcagtaattatacttgtatgttcagctgtatatttctttattttagggtgtgcacgtaaatcaattgcttttaaggcttgggaaagttcaaaatatcgatcgactaagtcctgttttgtaatattgttagtaatgctattgacgctaaaaaaatgataattagtatatggtaaaatatcagtatcataaccaaaagccacttttgctttaacccctttttcatcccagccaataaaccttccaattcgtcttgctgcttgtcctgagacgattttaacatatccaaatttagccataattaatactcctctttctttataatttcttagcagcattaaatattcattttaataactattttcaatgccccttattcgcttatataaaaattcatttgttggtacttttagtttatgctttgatgccaaagaaattactgttccagcaaacatttcaacttcactgtaacgacgtacttttgcatcttgagccattgatggtaaacccagaggagccaaagtcctaattatctcaatataatgcttcaaatccgtttcagttagatcaactccctcgtaatgtgacaactcaataatttccttcattgctgcaatcaaggtatcatttgcttcccctggcattaaagcaccactataattggtattatatgccatacaagtctgatttatcccaacattcaacatgaatttagcccacatactatgtaaaatatcgcctttaacttcataattaatttttgcttgatcgaagaagctagtaagcttatccaacttatctttttgcttgaaatcagtgattcccaataagagctgtccttctttagtgtactttagagatgttccaaacttcattgcatccattccctgagcaaccgcataaattactttttctctcccatagtattcactaataaccttttcactgtcaatcccatttaaaacagaaattattattgtatttttatcaacacattttttaatttcctttattacttcttctaaagcagtcccttttactgctatgattattaaatcaaatggaacggcattaaaatactcaactaaattaaataaaactttctcaccatttattgtaaatacagtttcctgatatgcttttttccttttttcatcaactataaatgtcactgcttctctagtaatgtttttgcaataaaatctccatataacattcctaaagcacccatcccaataattccaactcgtttgatcacaataatatcctccataagaaaaaagctgatcaatgaccagcttttgcatcaagtttcaattaattatttagataattcagcgaaatatttgattgttctaaccatgttagaagtatatgaattttcattatcataccaagcaactgtttgaacttcagtagttccgttgtccattggtttaaccatagtttgagttgcatcaaataatgaaccatagttaattccaataatatcagaagaaactaattgttcttcagtatatccaaatgatggagtagctgctgctttcatagctgcatttacttcttcaactgtaacttcaccttcaacaactgaagttaagattgtagttgatccagtaggaacaggtacacgttgagcagaaccaattaattttccgtttaattcagggataactaatccgatagcttttgctgcaccagttgagttaggtacgatatttactgcagctgcacgagctcttcttaagtcaccttttctatgaggtccgtctaataccatttggtcacctgtgtaagcatgtactgttaacatgataccagatttaattttagctaagttatttaaagcgttagccattggtgctaaacagttagttgtacaagatgctgcagagatgattgtatcatcagcagttaagatattttcgtttactccgaatacaactgttggtaagtcatttcctgctggtgcagagataacaacttttttagctcctgcatcaatatgagcttgagatttagctttagatacatagaaaccagtacattctaatactacatctacaccgatttcaccccaaggtaatttagaagcatctgcttcactatagattttaatttcttttccatcaacagtgattgaattttcaccagcttcaactttatcagctaatgcatatctaccttgtgctgaatcatattttaataaatgtgctaacattttaggatcagttaaatcgttgattgctacaacttcatatccttcagcaccaaacatttgtctgaatgcaagacgtccgatacgtccaaatccgttaattgctacttttactgccattctttatattcctccttgaatgttctttatgctcatattatattccagaaaggcaagaaaagcaactaatgtaacgggtttcattgaaaaaaattaaatatttcacaaaagattcataaatttaactttaatggaacaaaatctaacattattcttttataatataaatttagtgacttttacaagcctagttttaccgcaatctttcttgccttttataggcttaaatgaataattattattttaattactatacttaaatgtggaggtaagataatgcatttagttcctacagtaattgaaaaaacaaaccaacgtgaatatgcttatgatatatattcacgactattagaagaccggatcatcttattaaccggtactattgatgataagatgtccagcagtattgttggtcagcttctctatttagaatcattagataacaatgctgatatttttatgtatattaattccccaggtggcagtatcaatgcgggaatggcaatctatgatacaatgaactttatcaaatgtgacgtttcaacaatcgtaattgggatggctgctagtatggctgcctttttactcagtgccggagctaaaggtaagcgttgtagtttacctaatagtgaaattatgattcatcagccattaggagcttttgaaggacaagcgagtgatattgaaattagtgccaaacgaatcttaaaacaaaaggaaaaattaaatttaattcttagtaaaaatacaaatcagcccatagataaaattgttatcgatactgatcgtgatcactttttagaacctgatgaagcgcttgaatacggcttaattgatgaagttatttaaaacgaccaacttatgaagtgaaccccaaaaaatgatgtgtacccagttttctggacacgtttaaatttagttttaaaaaaattatgccatggatgctaatctgtacaaaacaggtggcatccattttgttttttctgtattcttttattgcagtagaaaactatgaaaatgaatacaattcattttcatacccataatagacttcattttttaatcggccaaagaaagtttccgttaccgaattatcataacagtttccttttctagacatcgattgtattatactgtgttcttttaatgaattgatataatgagcatgttgatatttccatccctgatctgagtggaaaatcaatccttcaaggatggaaaacttttcatatgcctgagtcagcatatttgtaatttgtttaagattaggatgcggtgataaatcataggaaataatctcatttgtaaacctatctaatattggagaaatataacattttccccatgcaaaattgaattgagatacatcagtagtccatttttgtaatggtctactcgcattaaaatttctattaataatattatctgctacattccctttataagaatggtatctctctttaggacgtttacctaataatcccatattatgcataagtcgttacactctcttatgatttaccagataaccgcgatttagaagctctctatgaactcgacgaactccatagcgtccccttattttgatcaaagatttcttttatcagtttcatcatctcatgcctttagaagatgctttaatcgatatcctttttcacgaatttctttaacgattgctgctcttaaacgtattagttcttctttctcaggaggagtaagttcacttgatattatagattttttcagaggctgctccttactatgtcgtcccttctttaaatcgagaccattatatccatatattttatatcgttttacccagtttgacagttgactgtgattaatattagcacttattgcaacacttttttgagattctccagctagaaccctggcaactaaagcgtatctttcttccacagtatactcagtgcaggtggtaggatgttttaaagcatctattccatgtaagtcagcgattttgacccatgtagtaattccttttctaaagtttttttgtccaattccttctggtgtttcatgccatcgaccatttttatatagttcaacacacttcaacttaaatacataatcatatttcatataaaaaccctccttactggtttgcccagtaaagagggtacgcatcacaaataatggaggttcattttattatcagttagtcattttttaatatataactgtctagatcaaccaaatatataaaaatcagctatcctaaaatataaaaagaagggaaacatatttcccttctaaatcaaactattgtctttaaaatctattttcatttaataatttgtacaagctaaataatcatactatttttgaattacgatattgatatgctaataaacctgttaataatagcattccacctggtagccaaaatactacaaaatgataccactttaattttaatcccttaaacttattcagcatcttatatcccctttatcaatctacatataatataaggatataatcacatattgtcaacataattcggcataatttagatttattaagactttaatttttttaccataaataccatgtcatcattaatcttaaaaccatttttctgataaaaatcagcactgtaaaattctcgtcctgtcaacaaaattaaattatcaacttcaggtaaacattcttctaatgccttcatcattttctttcctaatccccttctttgacaatgaggatcaatataaaaatcttcaatcataaaatcaagatcattaacatatgttattaatttcccacaaacaacaccagctattttgttatctaacatatacacaaaacaccttgtatattttccgtcgtctaactgttcaattcgctggtatgatctttcataactccatacctcattccaaggaggatttttaaatgcttcaaccatcagtttagcaatctcttcatagtcatttttagtgacacttctaatcatctaaaatctctcgctttccacaaacacaataattactcttaaatcgttctacagtatgaactacttctttagttaaaaaatcaataagtctttcatccaattgatgttcttcaaaactactttggttaggataaatgagtttaccaggaaactttgtttcaaagaaaattgtatttaaaatcgtaatgctttcaagataactccctaatgaagttaaatgctgattgtcactttggaacaattctaattcgggattttgatggcttaaacgattaatgacataacccactggtattccatcaactaaattatccatcattacttgatgataaatatctttggttgttttaaaatcatcatcataattccgttggctccaaggaatcataatgtatggcataacaccacagctacgtgccaattcaatcaatgctttagcatcatgcaatgttgcttctttacttggacaaggctcatgtgctgcctgttgaaaaataacaaaatcatatccttgttttaaagcgaactgtaattccattgactctaaatgatcgtgaaaggtaattgcaggacgggccaacattgtcacttctaacttttcactactattgattcgcaccatttctggcatatcattcatatacgtatgcgaattcccaacaaataatattttcatcctaattccacctactttcaaaggactactcctttagtatagcttcaattacgactacttagcaatctttttaaaagtaattattgctttaaatagatccccatcgattgcaatattaaaagtccccccctgtgcttcaacaaaacttttagctattgctaatcctaaaccactgccactttcatgacgcgatttatcaccacgaacaaatctttctgtaatttcttgaggactaaaattcatctgctcttgtgaaatatttttaaaaataatagtaatatcctcagtttcctccgttaaatcaacatatacacggctattaaatagagcatatttagaaatattagtgaatagattctcaaaaatacgatacgtcttatcaccatctaatttgaggattatatcattatgtggataattagtaataacagttaattgatgcgcatctaatatttcactacattcagcatgcgcctgctcaattaatgcaacaatattaagttccattaaatttaacttgatattaccactattaactttactaacttcaaataaatcttcaattaaattcgttaaacgattagaatactgatttaaattatctaaatattcatgtcttgtctctattggtaaattatcatcttgcaataaaacaatataatttttaatacatgtcaatggtgtttttaagtcatgagaaacattacttactaattcatttttcatattctgagacttagtttcttctttaacagcagtttcaaaaccaattcgaatatttttaaattcatcatttaaagcattaaaaatacctaaatcaccatctatctctacatcaaaattacctttgcttaattcttttgttgcagtcaataatttatcatagtcatcttgcaccttcagcactttatctttgacccaaaaaaatactaaaaatgcataaataatagctaggaaatatccaaaaccccaaaaagtaatcatgatcataatgattgctgtattaatcaaaatatatttcatgattgtttgatttaacgactttgatagatcaatatcggcaatttgattaagtttatttttgatactgcgtattccactaccaattaacgtatcttcttttaaataacgccagaatcctcgagcaaaaatgtactttaattggaagattcctaatgaaataactaaaagcgtcagtatccaaatcacaaaattaataactataacgatgtaatctacatacatgatgtcatatctttttaataattctaaaagtgaattattaagtgtataacccgttacgatcatacagcccataacgccaaaagtaatcataagcgttaaaacagctagatttatttctgctttccatctctttactgacaaaaacggattaacatcttctacaattttaattggataaaataagataaataagactaatatagctgaacaacttaataacgcaatagctgaaaaataattatagttttcccatgaattaacatattgtgaagcatatccatgactggctggtgtttctggaataatatatgtaatttgaagattcttaggaacattaatcttgattgcatttgtatcaaacatccagttgtcaatatatatagtattttcaccatcataatgtgcaaatgagcttaaaaggttagcaatattaaaatatgatagtttatcactacttaaatccccattacatgaaactagaccattttgatcatagctcgcctcagtatagaaactatatttactttgatcatcattagttgtaattttttcactatgttgagaaatcatttgattagtattagtattaacagctttataaataaaatctccatcattattaaacaatgatgttattccctttaaataatcgtcaaaaacatctaaaaatatttgtcttgtctgttcatcaacactatcatcaaagcttactgcttcaaaattagaatcaagggtcttagccatcgcaatagtaaaaagctgtagatcatcttctaaaattcccgttaaattatcatcacgaggggtattttctctaacattatcatataaggatataacaacaacggacattaatagtaatattgatgcaaaaatcacaccaaaaattcttttagcttttgtcattttttacactcctttttcaattttatatcctattccccaaactacttttaaatattctggctttttaggattagcttctattttctcacgcaattttcgcacatgcaccataattgtctcagtatttatggcttcttctttccaaacagcttcataaatctcctcagctgaatagactcttcccggataagacattaataattcaagtatttgaaattctttagccgttaaacgaacacctcgatcattaacaaacacttctttagtaaacttatccagctctaatccacccacgactaagcgctgttgattattattaagattacgattttcttttaaagctaaaatttgattatatcttcgaagattcgaattaactcgagctatcaattccatcgcctcaaacggcttagtaatataatcatcaccaccaatattaagcccggttattttatcaatatcttcagactttgcacttaagaaaataactggaaaatcatagttttctcgtagttttagtaccattgtaattccatccataactggcatcataatatcaaccactgctaaatgtatttcatttgcttcgattaatgctaacccttcttcaccattactagcttgtaaaacattatatccttgattcttcaaaaaaactgttactgtttctctgattcctttttcatcttcaacaattaaaattgtatgttccataatcttctccctttttctaattagaattaactatttttttataataaacggcaccggtaattactagtataacagttaccgcaaagattgaaacagccaatacaatattgccgtctcttaatgctcccattaaatatgtagatgtcacaatacttggaattcttccaatcgttgtaagcaatagccattgttttatatcaatatctgttaagctaactaaataagtcataatatctttaggacttccaggaatcaaaaaaataataaatagccaaaacttactttttttagaagaaaataattttttcacttctgcaactttactttgatcaaacattttatcaatgattgagtgttgaaagattcgtgctaaatagtaaacaataatcgttccaatcattgacccgatcaaacaaacgattgttccttgaaatgaaccaaaaatatatccactagccagctccaaaggttctccaggtaaaaatgctaaaaagatctgcagagcaattaaagcaatcattgctgaaactttagtaaaatatggcagtgtttcaatctcataaataacatcattaaaatcgcagtttctaaataaatatattgtaataaatgccatgaacaaaataattgatgacatcatgagcaaatttgtcttttttattgatttaagcataagtcgttccgcctttctatacttaaataataaaagactatcctaaaactaaactaacaataattcttaaaaaattctaaacaaaaagcaaaactttcgttttgcttaattataatcatcttcaatcgtagaatcgacatcctcttctaattcttctgtttcttcttcatcagcataaatatcattcatatcaatatgaacatcactaaatttatgacgacttcttaaatcccaggcattttcaccaaccgtgataaaacgtccgtctaaggtaatattagtataaaacaaagattctttatcttctttttgttcgtcatcaaatttcttcatttgacatacttcttcccataatttgaaaaaattaactgctgatttctttttagacattaattcatatgctacatcaaccatagacatattataatatttatccatactatccattcttgattatcctcctacatcttttctggggcactaacaccgattaaatttaaagcattagccattgtaattcttgtagcttcaactaaagctaatctttgtccacttaattcaagattatcttcatcgattacataacattcattataaaaactatggaataattgtgcaagtctttgaacataatttgtaattttgtgaggcgtacgattgatcgcactatcaataattacgtttctaaactcattaatatgctttactaattcaatttctttaggattaactaataaatcatacttatcactataatcaatgtttgctttagcagcctgtgctttaatcgaacacattctagcatgagcgtattgagcataataaactggattttcattagactttgatttagcaagtccaatatcaaaatcaaatggtgtattagcagctttagaaacaaagaaataacgtgtagcatcaacaccaatttcttcgattaagtctttaatagtaacagcatttccagttcgttttgacatttttactggttcaccattattcatcattctaaccatttgaataatatcaatatttaactggtcagcattataacctaaagcttgaatagctgctttcattcgattaatataaccatgatgatcagcccctaataaatcaactaaatattcgtatccacgatctaatttatttagatgataagcaatatcaggcgtcaaatatgtatacgatccatcacttttaattaagacccggtctttatcatcaccaaattcagttgatttgaaccataaagccccttcttcttcatatgtataaccagcagcttttaatttttcaattgttggtacgacccgatcattttcatataatgatgtttcagaaaaccaaacatcaaacgacactctaaattcatttaaaatatctttaatcttttgtaattcatattctgttcctttatttctaaagaaagcaattgctttaccttcatccatttcaagatatttatcaccatcgatctctttgatctttgttgcaatatcaataatatctttaccatgataaccatcttcaggcattgtaacatcttgtccaaatgcttgtttataacgagcgtatagagataacgctaaattatgaatttgattccctgcatcattaatataatattcacgagtcacatcatagccagcagcactcataattcggcagatactatcacccactgctgcccctttagcatgtcctagatgtaaatcgccagttggattagctgaaacaaattcaacattatatttagttccttgaccatatgttgtggtaccatatgcttctttttcttctaaaacttctttaatgattgatgtcattgcatcttttgccaagaataggttaataaatcccggtcccgcaatctctactttttcaatattggcattttctttatctaaagcctcaataattgcctcagcaatttggcgaggatttctctttaataattttgttagctgcattgctagattagttgaataatccccatgtgatttatctttaggaatttcaattgtaatactttcttgatcatattcttcaacaaatccacacgctattattgcttgtttaagcgccccttttaaagtcgcttcaattttattaattgccatcattgccctcctatcttctaatcactatatcttaattaaattaccattaaaccctcatgaagtcaatgtttttataacaatggtgcaaataatcttaagattgcttctagccaccctctaaagcgccctttaacgacatcttcaggggtcatttccttactcacagcaatcgttttcaagaagtcctctttaatatctttaattgctggaacatcatacatatagactccacattcaaagtgcagataaagactgcgataatccaaattaattgttccaacagtagcaattttatcatcacaaacaaagttcttagcatgaataaacccaggagtatactcgtaaattcgtactccgccatttacaagtggttcatagtaagagcgtgttactttaaagaccatttttttgtctggaattccaggtgtgatgatccttacatctactccccggcgaacagctaaacacaaagcatttttaatttcatcattaatgattaaatagggcgtatcaatataaatatatttttgtgcttgattaatcatatttaaataaacgtttttccccaccggcttattatccaatggtgaatcgccgtatggtaaaatatacccatttggacttatttcgggacatatataatgacgaggatgatatttatcataatcttcaaatgtatttaatgatgcattccacgttgttaggaacatcagtgttaaattccatacagcctcacccttgatcattacccccgtatctttccaatgtccatatttcactttagcattaatatactcatcagccagattaaaaccaccactaaaaccaacatttccatcaatcaccgtaattttacgatgatcacgggtattcattactgccgaaataaatggaacaaaatgattaaatgctatacacttgattccataactttccaatttttgataataacgaaatggcagcattgtcaaagagcccatatcatcatacataaatcgtacttccacaccctctttaactttttgctttaatatcgttaagactgtattaaacatctcaccttcttcaacaataaaatattccataaaaataaaatgttttgctttagctaattctttcaacaaatctggatatgtatcatcacctaaagggtaatatttaatctcactattattataaataggaaaattttcttgaactaaataattagcttgtccttttgcaatcaaatcctcaatttgttcaaccatcttatttggataaataaatggtctaatagcttcttcttgattagcaaaggcttcttgaagctttttagctggctttttattaccaaaaacaacatacaacaaaccaccaaaaaccggaaaagataagatgggaattaaccaaataatcttataactggggtcatcatcgtcattgttgataatatataaagttacgatcacacttaaaaaaataaaaactccttttaataaggtcgcatcagtaaaaatatagcgcataaataaagctagccataatatctgaacacatattaaaataatcgatacaacgatccggtttgataaaaactttagtattttcatcttagttctccaatattaaataattgagcatgacatatacttgactaatcaaattagttccatcatataattcatactttattttcacattatccccgttatcataactaattaatctagtttttaaagcaattgctccatatggagtttcatattgatttaaaatatcacgatctcttactaaatgcaaaacactagccccattatgaagtttaacttcattttcacttaattcaatttttattttattttcatcttgataactgactacaattttatcatcacctatctccagatgaccagaaccatcatatttaacagtttcttgatgttcttcatatttaaaaatacttcgataatttactttaattatttttttcattctatcaccgtgcatattataacacaaatccgtcaagaatacttttggtgatatgatgaaaaaattagtaaaaatatttgtaactattttagcaagtttagccggcatacttctatcactatatgttattgcatattgcatgggggaaccggatctaaacaagaatcgttatttaaaattatacgatgataatcaagaaatttattatcagtcgatcaacgactataccggtcattatgtaactttaaataatgttagtaattattttaaagaaagtattgtagctattgaagatcaacgcttttatgaccatcgggggtttgatccaattggaatcatgagagccctcaaagtaaacttcacaaatcaaaaaaaatctcaaggagcgagtacgataactcagcaatatgcacgcttattgtacttaactaacgaaaaatcctggtcgcgaaaaattaaagaagcttttttgacaatgcagttagaaacacgtttatcaaaagatgaaattctcgagggatatattaataacgtttattttggtcatggaatttatggtattgaaaatgctgcacaatatttttatggtaaaagtgctaaagaactagatttaaatgaaagcagtatgttggctggagtagttaatggcccaacctattactcacccttaaatgatgctaaagcagctcgaaaacgacagtcaatcgttttaaacgctctaatcgactgtaaggaaattaccgtaactcaaaaacagcaggttcttgatagtgatcttaatcttgctgaaacgcataaagtagatgataatatggctaataattactataaagataccgttattgatgaactcgaagaacttggttactacaacaatacatatttgaatcaaggtttaaatgtgtatacaagttttaatcaagattaccaaaaagtagtggaaaaaagtgctagtgaatatactaaggatagtaaagtcgaaacctcgagtatcgttgttgaaccatataccagtaaaatccttgctattatcggcggtaaagactatgccagctcacaattcaatcgtgccactcaagctaatcgacaaatcggcagtacaatcaaacctttgttatactacctggcgctagaaaacggtttcactccggcaaccacatttttatgtgaacctactacctttaaacttgacgataacagcacttacagtcctagtaattttaacgataaatatgcatataaagatgttacgttagctcaagctattgctgtatctgataatattttcgccgttaaaacacatctatttttaggaactgataacttagcttcattaatcaaaaaatttggaatcaaggacgtcaaagcaaatgcctcactggcacttgggactttaaatacaaacatatataatcttgccaatatgtataattgtctcgctagtgaaggaaaatacaatcatctctatacaattgaaaaaattactaatgatgctggtaaagtcctttaccagcacgaacaagaagataaacaattgctggagcaagatagttgtttagaattatcacagctattaacatctacatttaatagtacatttagtacctatcttcaagcaacaatggcttcttatcaacttgataatatcaacgcctgtaaaactggtagtaccgatgttgataacctggctgtagcttataatccacaagtcctggttgccagctgggtcggctacgatgacaatcgtaaaatggaaacagctgatgacaaaactgttgctaaaaaaaccgttatcgatgttttaaactataccaatgaaaacaaagatgttacatggtatcagccaaccgaagacctacagcaaattgcaatcaatccactaaccggtgattttgatgaaaatggtacagtctattggtttaaaaaagactaatcccgaagtttacacttcgggatagaaaatcttatgatcatttttatttttcttagaatttacaattgccccaacaatttctgatacttctggtaaaaaccggagttcttcatcaattaatatttcaatttcactgagttcttcagtatttccataataacgatagggaacttggctttgatcatcacttacaacataataacgaggatcatagccttttttttcataaaatgattcagctaattgtttttcatgttgatcgagcagatcatgataaataaacaatcgtcgatctaaaaagcgtgtacataaatctttcaaaatctcgtcattgccttcttttaagactgtaaaataataaaaaacgatcccctcatctaatttagtataatcattttcatcgacatgtccatcaagaaacggctttaaataacgaatatctccaaaatcataaccagctgcataaagatctttcattctcctaaaaatactaattaatacctgttcataactccgggctgtggggtgataataaacttgccaatacatatgatatctggctaaaatataattctcgattgcttgtacaccagaattcttaaaaacgatctttccatcacaaacagccatcactcgtaaaattcgggataaatcgaattgcccataagtagtaccactaaaataagaatctctaagtaaataatccatccgatcagcatcaagttgactcgaaaccatctgtactaaaattttattaggatgtgttttttcaataacactacttactctatgtgaaaaaccatgatcaaatttttctaaaagatcatgtacttcggtctttccgttaataattttaattgtatatgcttcgtggtttaaatcaaaggcatcttcaaaacaatgcgaaaatggaccatgaccaatatcatggagtaaagctgcacacattactgttaacttatcataatcatttaaataggctccaattgcactattaaaaatcatttttcgagcaataaagtaaacccctaaagaatgacaaaaacgcgaatgttccgcactttgatagacctgatgcgtcccgcctaattgcttgattctccgaagtcgctgcatttcatgactattgattaaatctaatatcaatggttgatctacatgaatataattatgtactgcatcacgaaaaaccttactatctgttaatttcgtctgttctaatcgatatgccgcttgattcatcagtcttcctcctcgtactcctcaaaacgatatgtttattctacatttgggtacttctttatatcaacttttgataaaaacatttctaaagaacgaataaatattttttatcatcatacatagcttgataaataacaacttcctccaatgtttcactatctaacccaatattcataacataatatagtttgcctttgaaatgtcgatataaatgtcgagtctttaattttcgttccacgttctcaccactttttctattttcattataatacatcttaaaagtttatgctataattgagtctaggaggtatgacatatgtacattaaaatcaatgaagcaacaaactatattaagacccaatatcatggaaaaattgatttagcaatcattctcggttcaggtctaggcccacttgcagatgaaattgaaaatcctatcgaattagattatcgcgatatcccccatttcccgatttctaatctcattggacatgccggcaagttaattatcggtacattagaaaataaaacagtaattgccatgaaaggacgttttcattattatgaaggcaatgacatggatattgttacactgccaattcgtgtatttaaaagactgggaattgataatttaattttaactaatgcttgcggaggaatccgtgaagatttaaatcctggacaaattatgctgattaaagatcatattggtttatttgccccaagcccactacgtggtcctaatctcgatgaattcggccctcgttttaaagatatgagtgaagtctataatcgaaaattaggaaaacttgctcatcaagttgccgatgacaataatattagtttaaaagatggtgtctatgctttttttaaaggcccaatgtatgaaacaccagcagaaatattagcatatagagccttaggtgctgatgcagtgggaatgtccactgtaccagaagccattgttgctcgtcactgtgatatgaaaactctgggaatttcgttgatcactaataaagccgcaggactttcaaaccaagaattaaatcaccaagaagttgtagaagcggctaataaagcagaaaaagacctagttactttagtaaaaggcattataaaaaattggtaaactaaaagcatcatactaaactgaccctatagaaaacacatttatcgtgtttactctatagggaacaatttaaagatgcttttttattttatttgcacagtatttaattttcgattaacttcactaatgtctttatcatccatagcccgaagatacttaattggttgattggaatcataaacatctatttgatcgacccctaataacctatctccatcttcaccgtaaatatatccttgtcctgctaaatcaatgtttgattcatcaaaaacagaaacaagctcatatttgtttggatccttaaaaacatcatagtatctaactactgctttcacgacaactgccttaccaaccttttgatcatttaccctaatatgatttccttgataaaaatatactccctccagacgatatccatccatagccttaacttgctgctgtgcaaaatttgccgcccattccttatcatatgctattttttcttgacaggctgtcattataaaaagaaatagtaataaacaaataaatttctttaattgttgcattatcctctcctccacaagctattatatcataaaaatatttttttattttaaataatctttatattatctaagttctaatgatatttacaaaatctataaaaataatacaaatcctaataaatactagtcatttaaccgattaacggactaatcgtaaagctcattatttttaataaaccatgaaaaaatttcaagtcttgaaaaaaaacacacgctagaatgcgggtttcaggcgatttgttacttatttgttacttatttagtacattttaggacgtttttaaatacaaaaaaagaacacaaaatctttcccttcttaaaaaattactgtgttctttattatacttgtcttcatatttttgactctactaactatatatttttgtatttgttataaatatggtaaactagtgatgaaatcattggaaaaataaatactacaattatataatcttcaaataattgcataaacatcgtcttacccatttttaaataaatatataaaatacccaaacagaaaaatatagataacatagatgaaaaaattggtattattattttaatagttttcaattttgaatcaagtgtatcttgattagatttcgaatttttgcatttttcctcacatgttagtaaatctacagattctttttttcttctataattatcagctgtatttaatagctgatttaaaatagataacttataagatttgttatattcggcattataatcattcattatttttgttattttttccataaatgaatccagttcattaaaatcatcatttttatttaatctgctaattatttcccttttttgaccatataatgaatctgtctgctgtttaaacgtcttcattgatgcttcacaactttctttagttacatcataaaggcgaactaaattattatagacagtatcctgtttttttgattctaaatttccaaaataatcataaaaataagctgaatcattataaatatctatttttataataacatcattaaaatattgtttagcctgagaataaggtaaagctaaagactcgcaaaaatcaataaaattttcaggctttttcatttacaaaaatactccaccatatctgcatctgaaagtatagaactaccgctatgatttgcatttttccatggcaattcatcgtgagtctcatccactaatctccaaacattcatgcttaatttatcctttaatatagatataattaaacatttttcgtcttctgtaatatttagttgtgagtttattcctctaattgggcttcttccatagacattaaaagtgctccatattttttttatcacaggcccatattcccaacattcaatattatctaaaaatgcctttttattaaattctttcatgaaatttccttgtatataatacatcactttttgtaattgtaaattactaatatataaaccattttcttctgcaagtgaaattactttttttgataattctaaagcatcatattttgatttcatttcacactccccttttcttattacatctttatccactttcatgataccacatttgtaacattttttgattaaaattgcaataaatgttacaaaaataagtaatatgattcctttaaacaccaattttcatcccttatttttattttcaactattaatatatatatatgtaatatttttttaatacttctattttatccaaaaaaatgaaaaaaaaacctagatcaattagacctaggcttaaactttatatttcttttattgatgcaaaaattctggtaatcgttgcttataacactatgagtagaaattatgattaatatcgagtatacaagttgataaaaaatgacaaataactataattgatattgtacaattattgatccccactataattccaatagttgtataatagggtatggtcctcctttccccttagccatacccaaccaagagcacaaaagagatatctcctcactagagccttgtgctcttttatttaaaagtttaatacatttgcatattttgtataatgtagtagaatagattgcgtacaaatattatttttgtacaatagaatattgttcctctcccattaacaatattcgaaagtatacaaagagtacaagttcacctctcccgttttgggcttgtgctctttttatataaagtttattgaaaataattacttattattatatacttttattaagcatagtacgtattccaaaattatgctaaaaacacagtgttcattcccatgtcactgtgtttttctttatacaaaaaagcctagatcaatgtgtgtgacctaggcttgaattttatatatttattgtttacgtgtatatcgcgatacccattattaataatactatgagatagccccatatacaaaagggtatactctatccttgtgtttaaacagttcccctgaatatcttcagcatttatttttaagtataccttttccataatctttacattttagttccttttaataaccagtcccatgtattagatcctactacaccatcttgaacaagaccacgatttctttgaaacacgataatagcttctttagtctttttgccaaagtccccatcaacaaccaaattaaatcccacactgtttaatcgttcttgaattaatctagtaataccacccttcgcacctttttttacagttggataactggagaatccttgtctagcaatttctgcatttaatctatttaaccagtcatcgacaggttgagaaggttctggtgcaggggttgatacagtagtgccataatcaatatagggacttttgccatgtttagtccattttctagatttagatccatttgaaacattagcacaagttgaaacttgaacaccattatcccatttaggagtagcttcaactactttgccattaccaatataaatacccatatgacctttcatccagacgatttcacctgaaacaatattgctaaaatccgtagacactccgctacacttactaataatagtatcagcattctgatccaatacaccattctttaaatatttaccattatcaggatagccccataagattccttttaacaaaccagagcaatcccactgtcttttaccaccagatgttttatttccgaaagttcctaatttataagcagtagctgtatttgctactgcttttactttatccactaattgtgatgctgttaatactgccatattatttatcctcctttaaatcaattccttcgatttctgcacgaatttttaagcatctaatataattacccatataccctttttgctcttttaaaagttctaaagaacaactaggtctaaagtttaaagttccagcttcatatttaacagtcattgcatctaatttatcataacggatttttgcttgaaaatactcacctctaaatctctctttataaccgttactattcatcatttcgatagtttcatttaattccatgttaattatccccactttctttattaattaatttatccgccacttctaaacctcttgttaaaatggatggtacgttataacctgcttctacaagattttctatgattgatctaatctcattaacagctaatgaccctaatacaaaccatccgattaatgttgtaatgccaagatcaattcctagtgtagtgccaatctctataaataaaacagatgcagcaaaagccacaagaatcataatccaatagcctaatttctttaagacacctagccatcctttttgcgaattggttttattggccaatttcgatttcatacagccagtaatccaatcaataacattaaataataagaacaaagcaaataaaatccagtgttctccaaaaataaagcttaaaaaagcgactaccgctccagtaatcgcattgtatgtgtccatgtaattcatattatttaaaacattcatttttttcattttcctcaccttcagtttaaattttattaagtacagctaatacatagccttccttgataccttcatcattaataatctgtttaatctgcgttaactgtgatttcgaagtataactaacttcttcttcgacagtttcgatttctctaaataaaatataatcattctgctcgtaatcattttgttttataattttgtaatttgattccaaaagttcactaaatttacttgccgtaacgtctaattcatgtgttttaatcataatttcatgccgtcctttcatctttaatttttcgtgtaccataatgtcaatactacatcgtatctagtattaccgttggtattgatgtaaacatctccacccgtagtgacaaataaatcagtacttgaatttccattcataccacttattttatcgttcgctcgcattgaaaattcatatcttatatttctatcaaaatttgcaatattttctatttttttaaaagcattaatagtacctaaattgtaagatttttgatatatctttttgccatctatccagtattcgcccgtaaactgttcttctgtactatatttaaaataaatgtcctttttctcaataggggctggagggactgaataatttccatttttcgtaaatactggtaattcttcaccattttttaatatttttccaaatatgttcaagtcatactcaatttgaaattcaccttctttatcgcaatagcgtccccagccgacaccgtttttgtgagggggaatattaagtataactttaccaatatctatatcgtgaattacagttactgtatttccaacattatcagtaatggaaacttctacttcatgggtagtatttaacgcataaccactaaatacatatccttgtccactgttaaacgcagttgatttacttgtattgttgatttttatacttttagtttttattgcattcccagttataacacaataagtaaatgtaggcttaacataaatgtaagtacccttgattatatctttagttcccgaactgtcgcatctgtatgtttcaaaagttaatgtaggcagtgtatacgcagtaaccgtgactttaaccgttttacttgctgttcttcctcgactatcagtaatcgttgcggtgaatgttatatcaccgcttttatcaaccacaccggtggtatatgtatttttatcaccactataactgtaatctctaccactaatactgtaagttttaatagtacttccatatactcctgatgccccgttaattgttaatttaatgctggattttccttgcagatagagtgaaccaaatggatttaccggtgttgcagtaatacttgtaaaagtcggaacaatattcgtcggtattttaacagtacaagtacaagtactgcttcctatgttcgttccaccattaaaggtatatgctcgaaacattattgctgtactgtccgcacctgttacactatttaacaaacttagtggtggtgtccacgtagctgatgtgctgtagtcagcacctataccagtttcaggaccaccatttagactataataaagatggtgagtaaaattatctgattttctatcaaaataaatagttaacgcactcccaaaagttccaccatcacatcgtactcctgacactcttggaattgtagttaatgtatgtgtataaccctgctcgcttgaactgaactgactgtgacttatccaaccagtaacgcttatagcttttgaaccgtcagcatcatgactaatagtaacatcccatgtacccaaacgaatcggtgttgatgtaattttctgtccagtacttataccagtactgtatactccgccgtttatacgagcatatactgtacctgttccatttgtagtataacctgtgtttgttcgccatacatctatccaaactcgtacaacagaggtgtttgaatttatgtcatagctcagctcctgactgttaacactgtagtttatatatttattacttgttccaaaagttgccattcacacacctcctaagttaatgtcagaccatcagtagcatcataattccagctgaatgttccgatatttaatttcgtcattacaatggcatattcaatgttaagctgttggtttgacagatatgctattctgcttccattttgatagaatcctaattccgtattagataatttaacagcaaagggactattgcttgcacctagttctaatacaccatcctgaaatctagcccactgtgagatttcctcttttgtggccataccagttagattatcattaatactgcttatactgtttgtaatcaatgaaattgaacttgcattttggactatctgactggataactgctctatcaaagttgaattgtcagtagtagaagtctgtagtttttcaaccagtgtagtcagcgattctttaagctggttgatcgcagaagtatattcagtggtaatattctgcttcatatcattgatatcaccagcaaaatcattagtcacttcccatgtagtaccgttccagtattttagaagattatcagttgtatcaaaccataacttagttttatcactaggtgcagtagcactatgaaccgtaccatcgtcacctttgtcacccttatcacctttaatcaaactccatgtataatcactggctgaagttgattccgtaagggttgtcttgttgtaagctaaacctatgtatgttttacccgatggatcatcagacatattagcaccactggcacttgttgcatacttaacccatgtataggttgttttaccatctgtaccctttggtccctgaattccagtatcacctttctcacctttgattaaagaccatgtataatctgaataattactgctttctgttgcagtggtcttattatacgctaaaccaatatatgcttttccagttgggctgtcactcataccacttgtaggtgtatccgcatatttaagccatgtataatactgcttcccatctactcctttaggtccctgtacgccctgtggtccttctattttaacccatgagtatttattaaaaactgcactgtcagcttcagaaaaatccacatatgttccaatatatttacctggtgtttctccattatttgaggtaaaagtttttccgtcatcactgtacttaatatgtagatacgaagtttgtccatcgcttcccttcggtccctgaattccttgttctcctttgcttccagtatctcctttgatcttgctccatttatatgaaacatatgagctcggagctgtatttgatgttgttgagcatgtaccaatataaacagcattctcagcactgtcagtcatcgggttaccattagcgttttgagagtatcttatatagaaataagaacttactccatccgctccagcaacccccttaattccctgaggtccttgttcacctttgattttagaccatgtataactgtcaacatttgtaggatcattagaattaaagtctacacactgtccaatataatcacctgctgtctctccactgtttgcagtaaacgacttcccgccatcattagaatattttatatggagataagaagtcttgccatctacaccattagttcccggtattccttgtgtcccctgagctccctgaattccctgaaatctcgcccatgtatattttgttggatctgtactgtcggtttcagtgtaatcaacataagtaccaatataaaccgacggagtttccgtcatttgactagagcttgtcggactggcaacactgctatatttaatgtgaaaatacgaagtctttccactagaaccatcatttcctttaggtccagccggtccttgaattccctgattaccttgtggaccctgaagtccctgaagcccttgtggaccagtatcgcctttatctccggtaatgacgaatggaattgttgttgaggtagtattattactaaattttgtcgtatctttgcgccatagatactgcccatttgctctaaccggttgagcagttatccatccgctgtcaggtggtgtcgtactgctggcattaactgcaaagtaaggtgtgatactaatcacactaacaccatcatccccagttggaccttgcggtcccactgctccatcttttccatcactaccgtcagcaccgtccttacccagtacatttaaactaaatgacgtaaacagtttaatacttgtgtttttatacgatacataacagacatatgtaaccgccggattagccttggtcataatatttttacttacattcaatattccattgctaacattctcgccattcgtaagtccagtttctgaactgttgattatctttttaaagacaatatcacaattacttaaatccacatttaataatccatctaaaactgctggagtaatcgtaatgttgttaatttcccagttagggctataagttccgtcagtatttaaaatctgtactaactgtgaaccggtaacatcaagaaaactgttgcctaaattagcaatgtcattattatcagttatagttacacttcctgtatctaattcaattccgcttatagaaactatacacttaaaattagcacttacatcaatatcattgcctgtcaatgtcactgatttgccagttttaaatttttcttcatttttataccattgaaactgtatatcagtctggtcaggtgtaatatcagtagtcccgttaacaacttgacaagacaggacaattgatttattttgttcatttaaaacagttgcatctgatatcataaaagctctatataaagaagtatcaatatcctctatcttagtattgatttcttctatcttagtgttaatttcttcattagtaattgtaagctgcccgactttttcattaagcccttcttgctcttttgcgatgacatccagtttaagtgattcctgatcttgcgttatctgcagctttcgtatgcgtgttgtattgtttattctcttgataacacgttcttcatttttggtagttacggttccatctatatcagataatagaaaatttccacccttaaatgtatttgataaatcaattaccataaaattgaattcatcattataattaatcaatttacctggtaataaattatcaatagaaatcatctttacagattttactgaatagaatgttaaaccatcgaactgttcgtatagagaatctacaatcaattgttcatcgagataaagattatttgcattaagaaacatcgtatttcctgtttcattacctgcttcaagtggattcaatccattctctgcatatatacgagtcactttataaacttcattcttttcataatttgttaaggtatctgtgtttgcaaatacatcctttgtaacttttacaaattcaagcgaattaatttcctttgcaaacacgttagccccgcaaagttcagctatccagcctagataacttcttataacaattgtattgtcataccacgcaacttctttattcaatacataatcaggaatgttagttctgattatagaaaaaccagttagactttctatttcatccaactggtcttttatttgtactggatatgtaagttttgtatcatacgcaatatctagagaatagttattgtcatacagttttaggctcaacgatttagtatacttttcgggttgatcatatatcttaaaatatcttttatctgaagcattagtttcttgaatttcccaatacacttcagtatcaagattatcgagaattccatcatagttatcaaacttaagattcagctggattgttggaacattaccaataagataaccctccgcaaaagaacttgaaatcttatagtcaagcagtcgacttgtcacatctaagtttccgtatttaattagcatgactacacctcaatcaatgcaaaagaaaaggacttagctttaagtccctctttcgtcctaatgtaattataacttttgtttcccgcatacatttttctagtggcacggattccatgagttggaataaatagttctgcgtcaaactcagcaggagttaccgcattgagaatattcatgatgtcgattgttggtgttatgttccatgtcaatgtgacttttaacatatttgatctaattctatttcttcttagaacacctgtagccactggtctaacactttcaccgtccaaatcctgaatttcaactttaatatcagaaggtgtagacaaagctacaccattcactttaatcaatgcttcatttgccatatactccctcctcttaataatcaaacactggtttaccagtttgtacctcatattctttaatattatcaattaccatcttggtcagtaccttcccattttccaaaacaaaattaatgacataagttgctccatttccactatccccatcaaaagataatctatctgctaatttttcagcaatcagatcaagtccctgggtattacgtttcaatggaattacagcctcagtacctgcctcaccaaaaatacctaaagttggtttgtttaccactgttccttcggctagcaaaggaatttgtggtacgcttatcgtgctaatccagtcaaaaggtttaagtcctaaaatacttactttttttattgattttaatgcactgtttataccatcgaatggaattttaattactttattgattcctttaataattgcatttacaacagcctttaagccatttagaataccgtctttgataccatcgaatacagcacctcctgtactaaatacatttttaactgctgtccatgcatcgctgaatttgcccttgaaccagtccacaatatttccaaatgcatcagtaatattgttccatacgcctttgaaaaactccccagttctgctgaaagcaccgcatatattgtcccatgcatgatcgaatatagttccaaaccattccgcaacatcagaaaatgcagttttaacattttcccactgctgcccaaaccattcacctaaaggcgcaaatgtttcacagatactatcccatgcattgctaaatatcttacaaaccttctcccatgtatcactcatatttagtgtaaagattccaacaaagaaatcagctaccacttgaaatgcaccaagaataatatcggcaacggttttaataacagagccagcaatttcaaatatcgtaataaacgctgtctttataaattcgacaataggttttagcattgtattccataactttgataaagtttcaataacagtattaatagccggcatccatccctgaagaatatcgcacacagcttgtattgctattcctaaaacactgacaagaaaatccgcaatcggggcaagaatgttagtccaaaatgctaaagcaatgcttgctatagcttctactactgttaaaaatacatctgttaataaattccccaatgggagcagcactgtattaaaaagcattaccagcgtatcaaaaattggtaaaaggcagcttgtataaaaattctgaagtattcctaataaagcacctaccgcatcattcacaagatttctaaaagactcactagtctgatataaataaacaagtgctgcggttacagctgtaataacacctacaattgcaagcattggagtatttaatccggtaagcataacactcaatgtttcaattaccccaacatccttgaataaagcaaataatgcacctatattagtaaataaattttttattgggcccgttaatgcggcccaatttttgatcacctcaaaagcaacaaagcccgctaaaactccagataacagacttgtaatgacaggagcattggtcttgagaaactctttaagcctattgacatagaccatcaccttatcaacagtagcctcaataccgctcgtatccggctcctcaaacgcactgccccagtcgattggatcaatggcatatccgccacctccggtaccagcgccagagccaccactaccagaactagaatcactcgcactgattgtatttaattcatcaaacccggccaatgaacctaacgccttagccgttttcttggcttgaccttctgtaccctttaatgcattatttagtccacctgtagaagctgttgctgtttttgcagcgttactagcagaagtaaaaccattcgatgcctgctgtcctgccgacttcttgccaaataacctaccaaaaactgcacttacaacattcgcaaatgtaatcagttttccaataatcatattcaaaaactgtactacaggcgttaatgcggcaatcaagccgtttccgataatccccaaaagctgtttaaatcgttcctgaaggatacgaatttgattagcccagctgctgcttgttcttgcgaaatcgccttgaacaaaggctaatctatccaaaacaaagttatatcttaaagttgtttgctctgcctgattcatatcacttatatttttattaataccttgtgacaatgcataagcctggagatttgtttgagtcattacaacacctagctcttttaaagtttctgtctcacctgtaaaaacagattttaaacgcacatcagcaagatcttgagatatgttataaaatgatgcgacatcacctgttaaacctgccaaagtgaccgccatatcactggctgcgttttcatttataccggcacttttagccatagtcatgtaagtgcccgatgttttcttggcgcttaactcgctcatcccaaatgcttcaagtgctgatttagaaaacttttcagctttccacgccatggagccaaacgctacatctacaacgttctgcacttcagtaagatcacttgcaacctgtaaagcctctttaccaagttttaacagtccagttccaaccgctaatcctacaagtgctgattttatacctgatatagctgatttgattttagatgtctgcgcagtaacattctgggtagctgacttcatttgagtttgaacttttgcaagttcatctctaaactgctttgtttcagcgttgattattacttttaattcttctactgtccttagtcatcagccccaatctgtttattatggttataagcgaacctttttcttttttctttaaattcctctaattcgtttatttctttttgctcctctgcttttttcttttcttccttaaataagtcaggatagtaatcccatatttgcttaatttcaacattgtcttctttttgagaaaataataatccaattcctctgatgatttggtcagccagaatagagttatctatagcccgttgtttttgtttcattatctcttttcgattaaaagaatcaataatatccttgatttcatctaaacttagttcccaaaaataaaaaggatctatcccgcagtcaactgcatttgggtaaatcccatttattaagtctgatatattagttacagttgttctttggcttcgtccaatttctcgctcatcatttctgccattgaaccagagaaaaaacccgacgcttgataaatcgggaaaaacacatctgtcatgaatgcagtttgtgatcctccctcatccacatatttttcaaacatttcttctacatccttatatttgataccgtggtgaaatttttgcatagcaccatgtgtaattgtaagcataatctttaacgctggaacaccattatccaggacgttaacaagattagtcttaaactgttcttcaagtttagtaattacacttgttgtgagttttaatttatactcaactccatcgacttcccacgtagcccatgggattcttttattttcttccatagctgcctccttatgcaatttctgggtcagtgattgtcaatttactttgaagtgcaatgtttaagttaaactcaataacaccattaactccaccaccagttcttttaacagaaacctgaccatcaaattcagttgtagttccatcctttaatgtttctttaaaagtagcgatctccccactctcctccaaagctctcatcaaacgatatggactgtctgttgatgtattttcatatttaaatttataggtgatatcacctgcatcaccgatacccatttcatactgtttaacggtatcatcaagatctgtattctctactttttcaggatcaacacccatttcaggaatttcttttaatccttttaattttgtataagtactttcagtagcagattttttcttatactctaaagttgctccatttgctaacatataaatacctctctttcattaatttttatgatacgcaaaaattttatttgtatctacaattgcttcatatctcataagtttatgcttcatgcccgaaggctcgccaatatctgaacatgaaatacgtttaaaaccaaattcagcaataaccttatcaatatcaactgcagtcgatgaagtactcttattgctccagatatcaatcctaatgcgaattagtgatgaagcttcaccttcatcggtaacttcataaacacagttctcttcctcgcagtagctgactgctggaaaatttgtgaaatcctgaggatacgtatcgctcagattatcaacaactttttcaagctgctcaactatcttatctttaatattgatcattttttcatcaccttgactatttcctttccaatatatctattcatctctttagtaatatcttttttctgatcatgcagcgctggatagagatacggccgtgccggcataccattagtacggtatccgataacttcaccaccactttctacaacacccaagccataatactcagcatcatcaacactcatagcatcagcaggtatcatccatccagtttgtgaatatttaggattaacatttggagaaatacccgcatgtttttcctgaccattgggacctgttccaagctcatagtaaatgccataatcaagattagtgtaaacagtactgcttgctccactaggcctctgttctgttctttccttgattgacctacctaaattaccgctcttagaattaaccaaaagacgtgcctgcttttgtacaagtagaccacctcgctttactgatttctttaagatttcaccctgaacttcattagacattaaattaagcttttttatgagtttatccgcattttgaaatgtcatcttaatttttccaactcaatgaatttaaatttgggatagctcttaattgaaaccaccttatattccggctcatcaatatttatacatatggcatcattttcacttatatttaaatcaccataataattcatgttaagcatataggctagtcttagcccataaagttccgcttgtacttttccaccagctggccagattaccgcttcaccttcaacaggatcaagatattctaaagctgtattacgttcagtatctttttttacgatatattttctaagtttgaatttcttcatctttcttcttagcatttaatcgcctcctagcaacagcactaagtctatatttatcgatacccgaaagtatctcatcttcactgcgatagctgcggtttactccgccctcgctatgacttgactccccggattcaccatctcgttcatatctcgcaactgcaagatcaaacttgaaatgttcaagttctttcaccaatgacgggcgattagttttttcaagaacagtttcctcagctttatcaagaaaaagagaaaccgatatatcgtcagtttctcctgttactttcttaaactcttcttcgatagtcattactgattaccttgagcatccttaatgattttacgaagttcatcacaattcagcccgtcactatccaaaccaagttcttcagcagttttctttaaatcctccagcttcattttagataaaggaacttttttgtccgtatcttgattagactgttctgatacatcaattcttttgtagccaagctttgcaaacctagaaaattctttttcatcgataatgagttctacattttcttttaaaacacgcatatcgacaccccctattcagttggttttgcatctttgatatttacaaaaattgaatcttctttattctctaaagtccataattcatggaatctacgatagtccattgcccatgcatttgctttttgatttgtcaatggatcgaagattctcattacatcctgtttagaaatagcgattggtgttgctcttggaacaataataaagtttgcctccaacgctttagttcctttcacatatccgccttgttcttgacctgttgttttaccatcatagattgtaattgaagaatacattctgttttgtggtgtttcaatgattggtacatgatcaactgcaggaacaattgtatcaataccaccttgagagaatgtaacagaagtaagtttccccgccatttctaactctaactgcagttttgctgctgctgtcatatgaattactaaatctccgttatacccattatctctaatcttagaaattcctgtctttaccttctctaacattgttgttttctctggtgtatacccgtattcaaccatagttcctttagtaattgcagttgtaatcaattttgataaacgatatgcatcgatttccggtactacccacattctttggaattcacccattactgtagatgctgttgctacaaagtttgtttcatcaacatccataggatccaattgaaacttacgcccacgatcttgagtcattgttcttgtttcataagacaagttaattgcaccctgttgataaccgttatcacgatcataggctcctaacccctgtaatgcaattttaggaatctttacctcagcacctccgctgtatcttacctgaccggcatttgcttccatccatcctgtcaatgcttcctgttgtgctactaaatctaatgtctgttgaaataaagtagctgttgctaatgtgttaattggcataaattaatcatcctttctatttgcccatcatatttttataaataagttcagcatctgttgttttatcatcagttgcttttttaatcggcttaccgcctttgatacggtcctctactgctttttctactgctgattgaaatgctttttctactgtttcaatcgatttgttgcagctctcagcatcagtaaaatttaaaatttcggccaacgtaataggaagccctttatccgccaactgttctttagcttgggcagtcaattctctacgagtaattgctgcttctctagtttccagatccttagcacgtttttgctcctgatactgctttttctctttttcactcatgctggccaatttctcggcctctgtctgttgatcaacaagctgtttttcccacgacttacgctctttagctaatcgacctttaataatattatcgacttcatcctgagtaaaagtcttggtttgttcttggctttcatcatttttaccatcttctttgcctgaagtatcttgattatcactaccgccggcatcttcatcagcaaacaattgaagatttagtggatacgctaatggccactttctaaataaatctttactcataaattcctccattttaagtccgtatgactatcccatctttttttgtcataagtttttggacataataaaggcgagatttctctcgccatgattaatttatttttctttctgcacttgtttgatttcaactgcaacccccgctccgactaactccttaatgcgtttaggatcagcaactgtcattaaggctccttcacggtaagaaagaccagtattcttatcgatcatattctttacaacttttagttttgccatctaaccacctccttttaggtaaaataaaaacacgctacaagtcaattaacgtgttttataaatttataaatcaaatatactgtgcatatagctatccaaattaataatagaattagtctaatcttgaaatataactacatcttgtcattagctccgttattttcatataactgtcgtctttagccatataactcaagttcctttctcaatgcatcattataaatttcaacaacttcccatcttccgccttcatattcatgatcataagctgctttagggcgagccgtaggataaagataatcttcttcactgtcatcaacaatgcgaagcattccgctatcaacaccaacacaatcgtaaacttgattgttagttaaaccgtcaacaccaaatgacttaccaatatatctaagctttccatacaattccatttttatttctttatcaagttcacactgataaaccattatagttttcatattaatctctatcctttcttaatttcacttttggttcatattgatgcttatcatgttcataccaatgaacatcaaatatatatttatctgacgtaacttttgcaacttttttagaccaattatcaatgttcccgccgtatttttccgataatctttttgctgctctaagagttttatcgctaccttttcccgcgataatatgtgtattcattaaagctgcccctgttgggataaatccctgctcaccttgccatacataatcaagatgtttatgcagtatccatccgttatttgtcgctttgtataataatttcaagtctttccaatccttaccatcattatacttcaaatcttgaaattttgcgaacgtctccggcaactctataccaccaataacactcttataacgattaaattgttcacgatcctttttagcatttaagactttctttctaaatatttcaacagtatccttaccgtattccttttgctgatttctaagccatttctgatagttttgattagcactaacaattttatctttacctgtgactggatccctaactctacgcttcatcttagcttcaattgccttattaataaccggctcagttgatgacctgcagtttggatgtaatggtggaacatttaccccctgcactgctttatcaagcggtatagttgaatggtcatgtgtttgacagattggagatgtcttcatatcatgcaccgcacaaaaacgtaccatttcaatatcagcttctcgatacgcttccatatctaaagcattactaataaagtcactctctgtacaaataagtcttctggaattataagcaccgacagcaaacttttcaacgatcgtatcagccatctgtttttcacttttaccagttaacacacccatcagcatttcttctttgactgagtctgctaaattctgggtattatcccagatacgctcgctatagtttttaccactccatttagaattaagtaatttatcggtaacctctggatcaatattttcaaagctaaaggctatactggttctttcatggagattatagattgagttaaaataagaatcatatgctacatcaatatacgtgagtgtattgacttctttttcacgcttgtagacttctctcatcatcacatcgagattcttctgtgagtcctgaagcttattgattctgtatcgatacgctggagcttctagttctttaagaagttcttttctttcctcacctttagctcctgcctttaatcttttaagcatctgatcatatgaagttggatcagttaaatcatttaacagagccttggcttcagcctcacttaaactatgctttttcctgtatttatcaaaaacaccctggatctgttcattaaaataataacaggatttttgataaagctttgccagttcctgacttgaggcttctgcgatttccatagctctttgaatatgttcagcctgtctattacgccagtagttactcactctaatacctcaataagaaacttcataaatttgttaagcagctttattattgggagcagaatcttttttagctgtttatttatttttgtttttatcttccccatcagcttcttcatcatcttcaccccctgagttgttaaacggtacattatctgctacaccaaacattttttgctgacgttccactgctttgtcgttctcttcatcaacttttttaatttcagtttgggcatcttcaacaaaatcaagctgattcaacaatgtttcctgtgatacgaaaccttttaaattagttataatttgagacagctccaacaagttcttaggcagtcctcttgaaaaagttggaatgattgcagttggattaatcgaaatcgctttaagattaagataattacaatacaatgttatacgctgtttaagtgcctttttataataacgctctttagttttagttatcatctcaagaccaagtaacttatattccattgccacacctgaactgttgccaacaaagttttcatcagtaagattaggaacatggctgaatgtataaatatcttctttaatagcttttcttaatacttccattcccgattcatcaaaagttctagcaatgtattctgcttttgcatcaagcggtaactcaagtaaaccattttctttaagtatcttaactacctcactgacttcttcttcatcatcgcccatcaaagccccataaactacaagaagcgcttcaacaaactgttctttgtcatttacgcggtcactcatcaacgtgttgtaagcgtcaattaaactaatctgttgttcaaaatcaccaactccatttttattatttagaatctgaataatcgggacatcacctaaaaaatgttcttttggttcttcatctacataaacattattttcataagttccttcaagcagcagctcatagatataattttctgttccaacagtagccttgtatttgtactttccggtaacagcatctttaaagcgatagtaataaaccccaaaaagaatattttcttcaatagtatcatcacatactagaaatgtatgttccggttctagattttttgatactggtgttgtctcattttctttaacatagacatactcatacgcaacacctgcaacactcatatcaagcgcattgtcatgatcaacatcgtcaacatcagccaaatcaaatgcgtctgtaagtttatcaatattcattttcttatcacttgtagaaaatgatatagccgagcttaaaaagtaacccgtcgcagtatcgcttatatcctttgcgtgattacatacaactttattattactggaaccctttatttttttagttcgcccttgaaccttatgtttaccatcataatagcgctgattttttctaattttagatgccacgctagaatgcttacgaattaaatccctaatcatcgttttatttagatttgtttcatcataatcattagcatcgattgtaaaatttttcatcagctacctccttgatttgtatatttagagcggtttttacctgctcttgctttatttctaataacatctgtttcacatccataacgagctgcatcaatcgtatgattattcttatcaggaaattcaccttttaagtttccctccctatccttttcaatttcatagtcattaaactctctagcagcgttaggacatcgtgtggggtctataattatctgttctagatcctgaagccatttaatcccgttttctacactgtcaggccctttctttgcaccaacgatatttaatcccaacaacttgaattcgttaattgtacgaggttcagcactatctgctgtaactaatttgtttaaaggatttagtttttttattttctttactgctttcttgtttgaaagacgtgtaccataaacctcaccaaaaataaaaagacgtcttctcgtcttgtcataattcatttttaaataagctaatggatcaccggcataaccaaaatcaagtccgttcttcaaacgatcaaatactgcaatctcatcatcactgatttctctaatatcaagattagtgaacacttcaccgccagtgcccgtaacttctccaagataatcatgattgtacttttcttcattaataacctttaaatgctccgcttcaataagaaactgctcgccaagccactctctcggcgcctgaagataagtagtatgacttatgtaagtatctggtcttttgataaggacttgcttattacaccagtttctttgactttcaggaggattaaacgagtagaatacacaatattcaggaccaccacgcaaaagagactgattaatattcctgatcttatcgtaggattcaaactcatcacattcttcataccatacatatttcacatatccgacaaatacctttgtagatttaagtttctttgggttatcagcacccttgaataaaataacctgtcctgttggcttatatgtcatttgtagtttagattcaggtatttcccaatcctcctgagcgttaagcatataaataccccatttgatctgttcatatactgaacctctcaaagtatcctttacccttctaataacaactgcattagacattaggccattttgtgcatctctcataatgcctaaaggaatttcaattcctataaatgatgatttaagagaccctcgaccaccttttaaccagtaatgggtatattcgcactccttaatcagtttatgcacatcccaaaacgcaggaccaattattgacttcaaactaacttttttagccatctatatcatcaactatcatcgttttgccattggaagtaacatcaaccttttcagtccacattccataacgtctccctaatagttcagcagcccttagactttccttttcatcaggcggtttctcaataacctcctgcatgccgtcaccgcacatggccagtacactcgaagttgattcaccacgcattactgaagttagatattccatgacttcctgttgtttagcaacacgtttactggcgatttcatccagacgctgctgaatataatcccagatttcttttttcttcaaaagtttatttgctctaactgcagcagcattatcgctcttgatattagaataggcagctttatatgccctggtgccgtttagatcaatcaaatattcatctgcaaatatcttttgtttttcggtcataaacgacacctcactttcttaaattaaattattttttcttttccaatcttcatagattccaagttttttgtacttcttttttaattttcttggaagtcttgacttcattgaagttgtagttgttcttcctaaagcattaacaaactttgccaacgattccgcaaatatttgaaaactttcaccgataccttcaagaaaaagattaagtccttttgatattttttctgctggttccatattttcttcctcctcttaaacaaaaaaacctctgcactgcaaaggttacaatattcaatttggttgcaggaggtggaattgcaccaccaactccaggaaaggaccctggtaagctgctacttgctatatcctgccataataaaaggcactgcgtgaggagtgccattatttttctaaatcattccattcattgtataccttaattaaggccttatatggtgaagataatgaattaagtttatattcaaactgctcatcttcaactatgtcttttatacatttatgatactgctttttaaatctttctttatctactttatcatctagatattttgaacacgcactatcataggtgtttaaatattcttcttttgcagccttaattgctatactatatctttcactattgtcattcgctagcattaaatcagtaagacgatatttactttgagctatgctttgttcaatggttaattctatctgaccttgactgtttttattttgtttgtgtgtttgatataaagcaaacacagatataattattgcaattatagctaatgttgcgcttacctgatcattggtcattatcttctgttcctctaatcatctgtaaaaagtcagtttcatccctactatctctcttctcataatttccctggtagacatcaaaatcctggttactgtactttatctctggctcatactttggttgcttttgttcttgttctcctggtttgaatggtttcttttcattcataattctttcctcccgttattatgatactcaattataccacaatatccaacataaagcgacaccacaaatattaatgaaaggaggcattaaatgaatggcgtatcagcaccaggtgatgccgctttatctgaagacaaaaaaagctctgggagaatgagctttttcatatttgtataatcaaggggaagtataagaaacacgaatcaaccaaaaagaaattaatcatctgtgtgtcttaaccaaaagaccacattaacataataacacctatttcactgccataccatgacacggactgacaactttattaaatttcaagattatttatagcatttcgacgatagcgatacacattacgctctgaaaaacccatttttttagcgatttcgtcatactgcattaagtgaatatatgcatatttcaacaccagacgctcctggatgtttttcaaagtatcgatcgtatgctctatcttttccatttcattaaatattgcttctttttttgcatatagttgttcaattgattgtcttgttcctaaagctggaccatagcttatagcttttatccccattatttgtccatcaacatatgtaagctgatctaacttatccctataggattttaaatactgtaccctttcgttgtagtccattcattctcctcctacagcatttctttaagtttaacttccagcttgcgtatatacaatacgactgtgtccttagcacttttgcatccttcaagcgaatcaagctgctggtaacgatccaacagctccttcatgagttcttgtttagtcatttctaaatcctccttattttgtaacagtatctgttagaagattaactgcctttaatacactctcaagtgtactgctgtactctttttcattttcacgatcagctcttaacatcttattttcacagattaaatcatcaagacgtttttttaactcaatacattcgtgctcatagttatgcgccggttttctagattcagcttcaccaagcttattaatctcactatacacagcatcaacagcttcatcccagcctttactgtattcgtcggatgcgtcggtaccgccaagaccggcaacaatttttaaaatttcacttaattctactttcatttactcctccaatttcataaaacatagccagtgtgtcttagctgctttaccgctcttgtgaccaaacaacggctcagcatccaatacacttaatattttctttaaatcaatttgtatctcgttccatttaaatacaagaacaccaccacacttcagaactctcatgcattcatcaaatccaaactttagatcatcttcccagtatttacctaactgaccgtattgagctttcataattgattttttccccgcccatcttaaatgaggaggatcgaagacaaccagattaaaacgattatcttcgaacgggatacttctaaaatccgctattacatcaggatgcactgcaatgtgtttatcataaacatcatattcttcatcacgaatatccatataaatagtattcttatgatgcttattgaaccagaatatcttacttccgcagcatacatcaagtatcattttttcctgttccatacgctattcctcctatacgtacaatcttaacttttattaacgtgttactattctccttctctcatccagcgcaatcgaaacataggtttctgaatctttctatcgcagtagtcactgacggtctgccggctgatatacaagtcattagctgcttccctggtgcctttgtaaatgcgattgttatcataacagtaaatcaacctacgaatacttgttcgaccaccgtaaagctcacctaattcctttcttgtaacaattttaagattcactaaagcattatcaccatagcacttatttctatgagtaactgcatgaccatcaggcacgagaccgttaaatgcttcccatacaacataactcactttagtttccttacaatgtatttttataagcatataacatgaaccgcttctgttctttttcacccaagaatttaataatcgctctttcccattcttgtagattcttttaacacgtccatacatagaagcaaaatatggtgtgtcgcgatactgtttccatatctcgtctttcagatcttcaatcatttcctatttcctcctcggttaattatgtttccttgatctttattccgtaacgctcagctagtaatcttttcttcaaacgatataccggtgtcttaacccctttgacatcttcaacaatttctacatcattttcaacataaacaaaatcagcaatatattttatttcacgaccataacagctcttatcaacaagtacaaatggaacctggagctggagattttcgataagcccagctctttccatctgttttagttgaatataccgtttagcctcttttttgctgtcaaacttgacatcatcaagaacagttttaaccgcatgatatttgcttcgtttaatttttttctgctcatgttgttcaggttgaggactatatttccgtccatttgggtaatcaaccattaaaattggatatcctcctccatgatgtcgtatgtattaacatcttccataaaatcactcggacttgacgatccattatgaaaataattatcgttggccatctgctgaactttttgagtatccataggtgcctcattttgatttctagtatcaaggaactgcacgctatcgcatctaacctcaacaacaaatactgttttaccgtctttatcatcgtatgttcgggtttgaatttttccttcaacaccgactaagcttcccttagaacaatatctttcaacattttcagcaggtttgcgccatacaacacaattaataaaatctgcttgtcgttgaccatctccgcttgtaaaattacgatttaccgctaaagtaaacgaggtaaccgcgtcgccttgttgagttcttctaagttcaggatttctagtcattcgtcctacaagaactactcgattaatcatcttcagttacctccttgcgtgatagaataacgcatattcttgtttcagtagttggaatgaagccaaccacttcataatcaccatccaactgtaaaactgtgtttttgtctttatgttttacaataagagcattttctttattcgccattattttcctcctattcaaactctgctaaaaattcatccagttcatcaagatcaacttcttcatcaaaaactggtgtgttagtatcttccgcttcaggcagatacgagtatttgagatttttattcatggcacttttgaaatatgccatacggttatcaatctgcttgtccttcatcagtccaagaacgtaatcagctttaacactcacatcaacggcatcatactcagcaagatattcacgaatgatttcatcaaagatttctgtttcgttttcagcaataagatttttaaataaaagtctttcggtcaggtaatgaatttttaattcaggcacgcaagtgcttttatcttttatcttatatcttttatcttctattgttatatctttctttagttgttgccctttgtttgccttttgtttgccctccgcttgcccctcgtttgccattgtatctatcaattcgtttgcctttttgtttgtggtgatttgataaacgtcatattttacaacggttataagggaatattggtttgtcgttttgactgctaaatcgtttgactgttttaaatgatttattgctgttctaattttcttttctgaaagctttaaatcagacgataatcgtgcaattgatgttataaaactgcctctggggatcactgtgcctttccactttttatctttccagtttgccattaaaagacagtggataaagacatctttagtattctgatcagtgtaccattcccatgatgtaaaactgcgaaacagtttaataaatgtatcattatccactaatagaactctttctataaagcattaaggaaaaagtagaaaactacttttcctttggcttgatttcaatgcaaactggctgtgtcggttctgctacatcacctgataaatccagctgtcctgcaactactcctgtaaactcctgaagtctgaatccagtaacttcgccagtatccttatcatactgaacctgattaaacaaatgaatttcttcactttttttaggacttaatttagaagtaataaccggcttaacactcatttcctttttatcatttttaggtatgaaagtaagtttaactgttaatgttcgtgccttatcatcagttccttcgtcaaacatattaaccattactttttttaattcttcatcaataagcttaacaatagaaccgttatttatatctaaaatacttcttgtatattttgcttccattttcatatccccctaaaatgccagtacaacatctttgccaataagttcttttggcagttccgcagtaagatactgtttgataagtttttgtacttctttttcaaagtagcctctatctgcaacgaatagtgcaacacggccatgctgatcaactcgaagattaaatttacgttccacctgaataagttcaggataggtagcaaccggtgtaagcgtaacgattgggttaatagtcaccttgcctgcaccgccggcaaatgcatcactctcaactaccaggttaacaccaatgccattgtcgacctgtttaacagtttttgaattgtacagattgcttacagtggagattaatttatccgtattgtctgtagggacatagcatgtatttaagttgatgatcatttcttcaggtgatatccattcatttaaaataagtctgggtacaataggtttacagtgaataagtatctgacgttcatatgtatcatctacgctactgagtactttgatctcattaccatccgcttgaataatcagcggcagctgaatgtttaaattctttgcttcaacatcgatgtatgacttgataatttcaacaagtccgcttaatgaacgcgtatcgatactttcaatacctggtgttgtaacccttcttaaactgcctccgaatttcgtatgaagcatacctttaatttctgcctgctctaattgagcgttttctttcgcatttgctaattcaactactttttcaattgcttgtctaatcatttttaatttcctcttcttcctttttatttgttattcttggggtataaaattcatcccgttcttcatgtcccatacggtaacgccatagcgggcactctacagcaggacattctcttacttcgtttgattggaaaccgcagcagtcaagacacttgtatcttattgccttggctctgctaactctcttcccggctgagtccttaaccattttttcaaacatgtttccatccataacatcactcctttggctttttcaacacttatagacacatcctttataacaaactgtacaaatgggtaatcttataactgaatactaaaacgtttctatacacgtcgcatatgcacctttttgttaaaatactcttactatcttgccggtggccttttggacctctgacttcataaattcttcatctgcattagcatcgctaagatgcaacagcattatttccttagttctgtacagttcgcacgatttaagaaaatcaatacatgtattaagattcatatgacttctcataagccgtttaatatgagtatcaacaaaaggatttctgtttggattgttaagctgatgttccaacctttcactgatataattacattcaatcataatgtaatctaaattcttaaacgaataatcgcaatagtatgaatctgtaataaataataaattctcatttgtttcatttgaatggatcaaaaaaccagttggttccttagcatcgtgatgaactttaaacgccctgatgctgaacgtttttacagttgtttcggcggtgatattagtatctaaagcaaatgtgcctctttgtccgtatataccgattccctctaaagtaccttttgatgcaaatatcctgatacctcgaagcagcaaatccttataacatttggcatgatcattgtgctcatggctgataagacatccagccagttcgctaagtttgtaattcgtagctttcttgatcatgtccagctttacaccgcactccaccagcagagtggaaacgccatcatttattagataggcgttcccttttgaaccgctggcaatacatgttatcttcattagaacggatccatagaagtttgagcagctttttcactagcctgtgcggttgccggctccggttctttttgtggttttggtgcattcaattccggtgcagcatcattttcaacaaagtcaacatcaataaattctttattagcatttgcatttatttctgactgtacttcatttttagcaattaccatttcactgtaatcttttaacagttcatcgggaataacattaaattttgcaagttcctgataaagctcatgaacaactgttttcaataccatctttttgaaatccgactgccataccattgccgttttagctgctttcatagctctatcaattctatctttatcaatgataatcgctgtttgactgccattattatgataagcaactgcatatgcaccttttactttatctttattcttaaaatcaatgttacgatttaaaatatccggaatcttgtgatcgatgatctcataatcaccagttttaaaatctcttttctggacaagctcctcaccttcaagaaccacatccttaataatgtttttaacaccatgatttttcttacaaaatttagataaaagtttttcttcgccctgatattgaattttaatattgatatctttttttccagctttggtattatttctaatatccagccagatttctttatcattcaaagacagtcccagacgcgcaaatcttttgacctgtccagggaagttacatccaatgaagttgatttcattgggattaattccttcctccatcatttttttatacgtatttaagataatatcattagcaaaagttttatcacgaggacttaactgtgtacctgatgaagctgctactccgtcaactttagacatcatataccccttaaaatccgtgttagctttagcaactgcattagctgctgccgtatctttcttttcactcatttcctattcctccaccattgttaaagttttataatcttcatcaacaaccagcctgatcagctgattatctgtcgctgtaatctttgtaactgattctgcattatctacaaatattggcatcctgatattaaaatgttctgataaagtatcaatgatctcaatacctgcattaatgcgactagcattgttggccatcttatatggaaccatgcttttttcattaggaaccatcacgttacatgattcaataattgcatcattggtaatttgtttttcaaacagttcaaaattaactgtcttgaatctctgattaatctttttagtaatccgtttaactttttcaataatgaacttttcacacaaacttaattcatactcataacgatcataatcttcagccagctgcgcctgtctagcttcaagctcgtcaattctcttctgttgttcttcggctaactggaatcggcttatatgagtatttaaagcagcaactttaacattgcattcatgaatttctttatcaatttcttcaattactttatctatttcattatcagtgttttcaagatctgcaagctgcttcttaataactctgtattcttcagtatcttcaaacggtgtaacagcagtaatcttacttttttcagtttcaatttgacttgacaaatccattactttaatacctaactgttcattttcatgaataagattatccagttcaagctctttagaagcaattttgtctttacttacatctgcaccctttttttgaagttcttcaagtttctttgacttgttaatattaaaagtagcaaatattttttcctgctgatctgctggcagtgactgtccacaggtttgacaaactcttctattctcatcaaattccattgctgatacagttttataatcattaagcagttcatttctcatttttgacatatagtcaatatcgtttttgtatctggaaattctaatatcattgctgctgattgtgtcattaagtagatttttcttatttataaggttatttatagattcctttatcaatctatttacttcatcaaaactattaatatgtgcaatacgtgcctcgcgttctttctgcttgatttcagctatacggtttgatttttcaacagctgctgaattaccggacttagctgctaacttgcggtcattcagactgcttatttcttttcttacttcaaatagctgattttcataatccgctttgctccctgctgtttctggaatcgctctttcagcttcatcgattcgacttggaatctgttttaattctttgttaatactgctcatattggtttttaaaagcttaatctgatcatcgatactgcgtttttgggttgttgatccgtttaatagcaaaatctcatttaaaggttccagttctgctactacattaataatttcttcatcagtataatcaccacaaatatcagtaagatatttacgtctatctttccaagacaatacatcactaaaataagttgggctaatgagcatttgtataatttcacgaggaccaaataactcctcaatctccctgttgtagtctttttccttaacaggaagaccatctacttcatatgaaatggtattgccagtaagctccttatttttattgccacgtttttgtgtccatttttctttgtaagttttctttaaaactttaacgattccattaacatcaaatgtacattcaacagtatgttctagattatgaagatctccttcgactccttttgttttaggactataatctgccatagtaactgacggcttatcagtcaataaataataataggcattaatgatcgttgttttaccagtaccgttatctcctctaatggatttgtttgattcatcaaaatttaattccaggtttctgattccctggaagttggttaatttcatttgattaattttaatcgacattcttatttcctcccttaactgcgttatagcaatgtctcttaccttccttaaaggtgatgatttttacagtaattcccccttctattacaaaaattttgacatccggaacatgtttagatgtttcgatacgaaaacgcacatcatgatcctcacgcttcatgttaatcatttcaaagtaagcatcattaaggtgcttactgaacatgttatggttgaagttagttgacatctttgttatcccccaacagttcatccataatttttcttacttcttcagatgatggaactcttttatttgcatttaatttttctataaattcttttccacattcttttaatacatcctcaactggtttgaaaatttcaattatatcttcttttgtaagggtgctgatatcttcaacatacttgagcatggcaaacctaagacttccgcagattgaattttcaataggactgattttaaattcatactgtatcagcgttttcggctccatattttcttcaatttcatctaatagtttttttattgatttgcttttgttgccgttaatctttactacttttatatcagctcctgattccattgctgattcgattaattccttgattttatcttccataactttctcctctgttatatctttctatgatctggtcccgatcagctgttactgtttcgagactggaccttaaatttctaattactaatacctgataaacacttagcacaataaacaggactaaaagtatgctaagaaatttaataaataccttgtctttcataagaccatacctacgatacctgctaataattcagcaaaaatatataatgctgctacaatggttaaaattccttgcggttttagattattgagattcatggttggcactcctcttaaagtcctcagtcatcgcaatagatgctacagattcaatgatttcatctaaagtcatgcctgaatcaaataattctttcactaaagccctaatcttatcttccactttgacttcctcctgaatatcttctataatgaagatggttttatttttgttaatcgtcgacgttgccgcgtcggcttttttgtttacttaaaatctcaactaatgtttgaactaattcagttgttggatttggattccatttggtcatatagtcctcaaatgctgctcgaggaattacgatagatctatggccattttcattctttgtacagctcccgggaaataccccctgctcaactgcatttctaacaaatgctggatccttattaagacgcttagcacattcttcaggtgtaatagtctcgactctttccatctttctcacctcctttgatgcatcaccttcactcatgctataattgatttgtcgaatcccaatatagaaagtgaggtgaaataataatgaaaaaaattattacagctttttacataaatgattttaatgaaaaaatatcagtagaaataaatcaggcaaaagtttgtcctcattgcgaaacggcgacgaataacaacgaaattcaagcatattacatagagaaaagtgactttggttacgacaacatgtttgttatctgtttctgtcaacgctgcgaatcttgctatctaattgaatatcttgttgataatcccggttcaggatatcaagctcatacagttgatcaaatctctgtttatccatatcctcaaagtcaagaatctttttcagacaacatattgattctttcgaataaatttatcgacatatataaccaggctttaaaagccgaaaatatggctttaactgaaatttgtggcatgggctatcgcaaagcactggaatttttaattaaggattatgctattaaatttaacaatagtgacactgataagataattaaaatgcaactatctcaggttattgataattatattgacaatagaagaataaaatcattagccaaagcttcttcgtggttaggaaacgatgaaactcattatcaacgtaaacacgaagattataatcttcaacacttaaaatcgttcattcacgcagttgtcgcatttattgattcagatttagaagtttacaaagccgaggaacttttaaacaaacctaagaacaattaactttgttctttttttatctctttttccaattcgcctataatttccaaaaaatctatataagattttaagaacttatttaaaacttttagccattcgatatcaatctccttttttaacgtctcaataatttgctttctatccataacttcctcctttttttcttctgcccctttcgtgctataattagcttgaaaggaggtaaaatataatgactaaattagtaaaacccggtaccgataatgaaccaaaaggaaaatataaagaagtcggtccccgtggtggtgaagtacctaagcctagagttgtttcaatagatcctggcgatagattaccaccaacccaagaaaaaggtagaaaatggaaaaaaatataatctaccatcccttagcactctactgctttgggatttttatcttcctcttagaaaaacaccataccagtgaaaaaatattaacttgaatccatgattcaacatataattcactgttctctatatacttcgttatataatgatgtatcatccctgccactcctcctaatctgttttaaataatttcttttaacaccgtttttataacttttaatatgtgtcttttcaggacacttatttttatttagagttataatttatttggtcgatgaagtattttagtctttagtaacttttaaagttactaactgtgcaaaaaaaataggcataggatcttgtatttcaagtaattcaatcattttatcaatttcatcactaccaaaaataccaatcttcatcttttcataaaatgttttttctgtcattcccaatgcaaaagctacttgtctttgagaagtatttctttcagctataagaccttttaacttttgtgtatcaatcatatcatcacctccctttgtaacttatcacgttaccataataacattctttttgtgacttgtaaagttattttttgtacaactttaaacgtataagttactattcaggtgttttttgttgcacgttaagttatttatgttataattttattgaaattcaataataggaagtgataacaaatgacaattggtgaaagaataaaaaatttaagattaaaaaataactataccttagatgaaattgcagataaacttggtacatctagacaaacaatatttaaatatgaaaataatatagtaacaaatatacctagtgataaaattgaaaagttagcattaattttcaatgtcagtcctgcttatataatggggtgggaaaattcacaattaggtgactatgaagaaaatgtcgaatatttaaagaatcaacctgaattgttggaactgtataaggaaatacttaaaaatgatcaacttgcaattttatttgataaagcgaaaaaactagaaccaaaagacctagaacaaatactaaaaatcatcgatacatttaataaagaaacgagatgattatatggaatttgaggactttctaagatggcacaatattagtttagtgctggaaagtatgtcctcttatgtgaggggatttgcatattataatggtgagtcatatttagttaccattaatgcacgctgctgcaaatgtcaacagcaaacaactgctatacatgaacttattcacatctttgaaaaccattttacgtgtccacaagaatatgccgaacagtgcgaaaaagaagttcatgatattattgaattattaaaaaagaaatttggaattaaataattggagagaggggtcaactatatgaacaaaattacaaaagaagaatttgaaaaattaaataaatggtattacagtccttattttgctatttttttatcattttttggggttctttatggaataccattaataattgccattactttgcaattcattagacaaaagaaaattaaactattactacaacaataccaacctttaataggtcatgaagaatatgtttttggtatcattgattacaattctaaattagaggaagcaaaaaacaattactctaaagaagttcagaatttggaagcaaaaataaccagtatagaaaaagagtattctgaaaaagtccaaactttagaaaaaaacattaaagaaaaagaatctgatctaaataaaaatttagcaatcaatgttaagaatctcaaaattgatattgaaaacttaaatgaagagaaacaaaatttattaaatgaactagacactttaaaatcagaagcaataaaaaaacatttcgattttgctgattttgaaaatgtcacttctgaagaatacaaaaataaattaagtatttctcgtattaatgaagagaatgatttaaaaaatggcaacctacttgctatatcaccttacattgaggataaaaagtttatagcaaataatacaaaacaaataacccgtttatttaatgcagaatgtgacaatgtaatgaataaagtcactataaaaaatatcgatacttcccgaaataaaataactcgttcattcaatagtttaaataagatttttgaaactgatggtattcaattaaatcaaaactggttacaaattaaactagatcaactaaacacgctatatctatatgaaatgaaaaaaaataatgaaaaagatatacaaaaagcaattaaagagcagatggtagaagaagaaaaggtaagaagagaaatagaaaaacaaaagcaaaaattagaaaaagaccagaagcaatttaacaatgaagttacacgaatgatgaaatatctacaaaaaacttctaatgatgctgaaaaagaactatatatggataaaatacgtgaattagaagaaaaaataaaaaaattggaagaagaaaaacaagttgttcttgatagggaaatgaacgcaagagctggatttgtatatattatttctaacattggctcatttggagaaaatatttataaaattggtatgacacgtagactagagcctatggacagaattaaagaattaagtagcgcttctgttccttttgaatttgatgttcatgcaatgatttttagtgataatgcccctgaactagaaaatatattgcaccaaacattccgtgaaagaagtgtaaataaagtaaattttagaaaagaattctttaaggttacactcgatgaaatagaagatgtggtaaaaagaaattataataaaacagtagattttattaaagttcctactgctgcagaatataggcagactttagaaattgaaaataataattagcgtaaggtgataaattgaatctatacataaccaaatacggtaaatacacttcatagtgtttatataaataaaatacgaagggagaataaaattatgaatcataatgaaaagcaactatatgatgaattaaggagtactgctgaagaatgtaatgagctaatgaatatgatcttcgaacgccaattaccttcttgtgaattaaaaagtaaatataaaattcttaaaaacagttgtaaaaatagattacagcaaataaaaagagttggaaagccaataaatgtaagtcaaactgtatataataaatttttaagaaattacagcgaagctatggcctttggtttcactgaaccaacaaatggaaaccttgataaaatgattcattctttagaagaagcgcgttacaaatttacaaagtttttaaatgaataaagtaattctatagggaggggctaaaatggatgaaaatgattacatatctttaagaattgataatcaaatagactggtacgataaaaaatctattaaatataaaaaatgccataattttattacaatatgcagcatatttgtttctacatctggatcaatgataactattttaggatatatttttactgatttaaagatcgctttctctatttttggggctatggctggattttcagttgcctttatgctatcactagataaattaaaagattttcatgaacactttcttacatatagagcaacttgtgaaaagttaaaacaagaaaaatatttatttctaacaaaatctagtgattattatcaaaatgatcaagcctttaatttatttgttgaacgctctgaaagcatcatggcaacagaaaatcaaaattgggctcaactaaatgaaaaaaagagggattaaccttcttctattataatatcataagttttctcaaaaatttctggtttacagggataccgttcaccattgacaccagtaataatccaatcacctttttcagccttcattctaccttctaaagtatctatatagaaagaatgatctgtttgatatgcatcaactagtattggttttttacgcactttatattttgtcatatgaaccacctctttgtttatattataaccaaattcattttagaaaggaagtgaaatttatgccatcattaaaaacctatgatctttttatcagtcatgcttggttatacggcgatgattatgataatttaattaatttacttgataaagcttcttacttttactatagaaattattctgctccaaaagaaaaaccattagcgatatcaaacaatgcttttgattatcaaatcaaagaagcgattgataaaaaaataaaacctgtaaattgtgtaattatattaggcggaatgtacgctcacagaaaatggatgaaatacgaacttgaagctgctaaaaaacttagaaaaccaattattatagttgctccccgtggacaagaacgtatgccgatagaattacaacaatatcctgttgtgcgttggaatacagattcaataattactgcgataagacagttatcaagataaaaattcataagtcctaacaggtaaatcataaaaaaactccactgctaccaacagtgaagtcgaatgaagtactaccaatacttcatatttataaaagactcaaccaaaagtccttttacgtgcttaattataacacctaaacacgtctaaggcaaatatagaaaggacgtgtttttattatggctagaaagcagacttttaagcgcaggccgaacaaagcaggaacagtaataaaactatcaggtaaacgaagacgcccctggtgcgctaaaataactactggaaaagatattattaccggtaggcagatacaaacagtactgggaacctttgagacctgggatgaggctgatgatgctttgactttatacaggcttggtcaaaaaaataagattactgatacggaagctgaagcacttgcacccgatacattccagaagcttgttgatcagcgtgaaaagaatatgcctacctttaaagaaatctttgatattatatatcaggaagaattgtgcacattatcgaaaagtgctgctcaaggttatagatcgtggattaaacattttaacagtatataccaccacaagatcagtcaaataagtctggccgatctgcaggaaatatttgatcgtgataaagctggttacggtacaaaagtacatatgaaagttttagttagcaaaatatttgaatatgcagttattcacaaatatataaatcgtgacgatgattacactgaatatataaaatgcggcaaagcaaaagaaagcactaaacattatgctttctcaaatgacgaaataagagtattgatgagcgataacagcgatacggctaaaataatacttatttatattttcaccggtttaagagcaaatgaactgctgaatatcccgcgtaaaaatatttgtttaaacacagaattcccctatttagtatctggatcaaaaactgatacaggtaaaaatcgagtaattcccattcatacttttatcgaaccttttgttaaacagctgttgatgaagaaaaagaaaagaataattgactgtacctactatcagttttcatctatgttctcctcttttttaactaatcataatatgaagcatacaatacatgatactagggatacatttgcaacattatgtcagtctaacaacgttgatctgtttataagaaaacgtattcttggtcacaaaatgaaagatataacctttgatacttatacatctaccgtaattgaaacactatataaagaaatcaacaaaatcaaggttcctaagtcttgaatttttgttacttatttgttacttacgaggtacatttaactgcttctaatcgcttgaaacccttgatttatcgtcaataagatggatagatattttcaagtcttgaaaaaacaaaacatttatttgaataaacgtgtatgctttatgtgtaaaataaatatacggaggaaataagatggaaaagaaacctgtaaaaattgtaacaattggtggaggtagtagttatactcctgaattaatggaaggatttattaaaagatatgatgaacttccaatcaaagaaatttggttagtagatattgaagctggtaaagaaaaactagaaatcgttggtgctatggcacaacgtatgtgggacgcttctccttacgatgttaaagtacatttaactttagatcgtcgtgaagctttaaaagatgctgatttcgttactactcaattcagagttggtttattaaacgctcgtattaaagatgaaagaattccattctcttatggtatgttaggacaagaaacaaatggagctggaggaatcttcaaggcatttagaacaattcctgtaatccttagcattgttgaagacatgaaagaattatgtccaaatgcatggttagtaaacttcacaaatcctagtggtatggttactgaggcagttatgaaatatggtaaatgggatcgtgtaattggtttatgtaacgtaccagttggggctatgatggctgaaccagaaacaatcggaacaactttagataaattaatttataaatttgctggattaaaccatttccactggcaccgcgtttttgatttagacggtacagatgtaactggaaaaatcattgatgcaatgtatgaaggtaaagattctggtattcctgcaaatattcatgatatcccattctttaaagaacaattaaaacaaatgaatttaattccttgtggatatcatagatattactatcgtcaacaagaaatgttagctcatgggcttgaagaatataatggaattggaactcgtggacaacaagtaaaacaaactgaagcagaattatttgaattatataaagatccaaatttaaattacaaacctgaacaattaactaaacgtggtggtactcactattcagatgctgcatgtgaaactatcgcatcaatctatgctaataaaaatactcaccttgttgtaactactaaaaacaatggtgctgtacctgatcttcctgctgattgtgctgtagaagtatctgctcatatcggttcagctggagctttagctatcgcttttggaccattagaacctgctcaacgtggttggttacaatgcatgaaaaatatggaattatgtgttgaagaagctgctgtaactggtgattatggattagctttacaagcatttatcttaaatccacaaattccttctggtgaaaatgctaaacgtgttttagatgaattattaattgctcataaaaaacacttaccacaatttgctgataagatcgctgaattagaagcagctggtgttacagtaaaagatgaaatcgctagagatttagactaaataaaaaattcgtgaatttgatatgatctctctaaaatagacaacttaaataaagttgtccatgaaaagagggatcttttcttatggcacgtaatatacaataaaaaaagatacaagcagttttagagtataagaacagaattaaagaaataaaacaaataataattcaagagcatttaaatagtaaagattctttgagagatttaagcaataaatacaatactcattcttcttcatctttatgaagttgggctatcagttataatagtcactaaaaattaacagattatgatcctaaaggagatgtctacatgaccaaatcaaaaaaagcaacattagaagaaataattaaaattgtataatattatttagattatgagaaagaatataaatcagcagctgaactttttgaggtttcttactcacaagtatatcaatgggtaaagaaatatttagaattaggtgaagaaggtctaaaagacagtagaggtaagcgcaaagaggaatcacaattaaatgagttagaaaaattacaatatgaaaacgaacgtttaaaacaccaatctgaacttaaagaaaaaaatattatcttaaaaaagttgaaggaagctaatattactcaaagtatgtcaagagttggaaaatgtatcgataacggttctgctaaaagattttggagaattattaaaagtgagatgtattatcttaacaaatttaattctttcaatgaattaaaaaaagcaattgaaactcatattgacttctacaataacgaaagatttaataataaggtaccaatgaaagtacgtttagaagctctaaatggtactgaaaatccagcacaatatcctaccaataattcattaaattacgcaatggtataataaaagatgctttaccaaatggaaaagcatcttttattttgttatttcttatttcttgttggtttgtacatcccacccggtgaataattatctgcatattttttagatacttttttcactaatgaaactacttttttctttatagccatgttttttcacctccatacttacacctgtaaaaaataaagtaaaaccaattatcatgcttagtcgtggttctataggataaattaatccaatcacagccagacatccccaaaaaattaatttacttattttcacattccgtgcttcatgattttcttgccacataaatgctttagcagcaataagtattgccataattagaagatagctattttcaaaatccgcaaaatagagcgtaccaagatataacaaagtcgttaaaaacatacagcgataaaaactatcagcatgataaccgtctacaaatgtccgtaatccaactaatgcaataataaatattattgtttctagtaccatatttctaaaaatgccgattgctaacaacaaaaaaaataaaatcatttgagtcaaaatgagttcaataccaaatcttacttcatcaatttcatcctcagtcacattatcaacatctaataaaaatatgcttattttttcacaaaaacgtttcatatctatcctccatgtccattatactattaaatcttcctaaaaatattttcaatgtactaaccggtcctattttgttattaaatacttctaaaaaaattaaaactttgtgccggacaatagcacaaagctttaaaaaaagagattagattattaattcaaacttctatccaatagacgtttgtgagaaatagctataaatattacttgcggccatgtagtaatattataacttggagattatgtatagaaagacaatactttttattttattattattacatctctcccataatctattatactacacaacttaacagcttgcggttttatcctttttttctacactaacggtcaatattatgacataaacggctttttaattatcaacattcagtaaaatatcgcaatgcaccttgttattttcatagaaatattccattgttccatgataggtttctacaacctctttaatgattattaatccttttccatgatctcttccttttttactttcataattaagaggtctattagtcgaatttattatgctgatcaaaagcatattgcctttactaaaaattttgatttcaactatcttctccgctgtttttaaagcagcttcagtagcattatctatcagattaaataatagagaacataatttgtcttgagcaatattaacattgcgatcaatcactgcatctacaacataattaacttcatcgttattgcgaatcttcgcatttaaacaagcatctacaaaaatatttcccgtacgtatcaatttaactggagcatttaaatcttctttaattgcttttaaatattggttagcgactgattctgtttcgactacttcttctaggacttgtaaatgattattaatgtcatgcttaaacttataaagacgttcttgttctttttctaattcactaatatgacggcgagttgtagcatatgaataatttgctaactctaactccttattacgtaaatacatacgggaagaattgatgatataattatttaccaaaatcatttgaacacctgctaagatcaatataaaaaagatataaatatccccctgttcaactgataatacgtttaaaatcagtacaataatcacttcaacaatattgatcaaacaaaacgaatataaaaattttttaggtaactgatgttccacaaaatcacgtttttgaaccgcatatttgcatatcaatgctgatgatatatagtttcctaaaggaaaaacaactcgcatactcccccatacgatatccaaatatgtattgtcaaaaatttctagcgccactgcaatcataactgagccgacaataatttgaattgaataataaattgtagtgataaacaaattattaagcctaaatctcttaaccaataccccacaataaataaaatccaaactaatacacattaaattaccaattacatataaccagccattatgtggtgaagtatacgtaacaatattcaaaacaaacgtataacttaatataaccataatatttctaagcatgttttctttacgaatatatggataggttaatgaaataacataacttaaagcaacaacatatatcaatgtatataaatactcaataaaaaaattaatcatcactctttgatctcctgcattaaaagattaaatacatctttttttcttcttctactaatttctagcgattcatcaataccttttaattttaaaatatatccattcatcgaaacaaccatattaatattgattatctgacttttatttatttggacaaaattatctggtaaatactgattaacttcttcaagcgtcatataaggaatatagaaattattatcattagtataaaaatgtaagtatctttttactgattcgatataaataatatttctacttcgaaaatgaaaaatctctccctttttcttgatccagatatcatcattttgttgtctacgatttatcgctttaagcaaggttggcgttaactttgtttctaattctgatttaagtaaatatcctgctacattaatatcaaacgcctcctgcattttattttcataattagttatgtatattatgatcgtattttgtttcaataatttttttgctacctgtattccactcattgttggcatatcgatatctaataaaagaatatcaaagtttttaccacaattaaaaaactcttcaacatcttgaaaaagttcaactgtatatggttccttaattctagcctcctctacataccctctgattctaagtagcattgaccgctcatcatctagtatacctattttcatctttacacctcatttatttattatacttgataaaaccttttttgactaattaaaaaaggcccttaggccttatcctgttgctttttttcatagtaatttcttaccagcacttgtgttttacgaatatgattttgaattttttctttagctaaatccttatcacgagctaaaattgcctcataaatttctcgatgctcctgtgctgctgaaattaaacgatccggttgacgaattgaatgccttgaagttacatgaatataataattaatatctgttaataattgctcaaaatactttgattgggtacaacgataaatagcctcatgaaaagcaatattaatttcattaaacttctcttgatcacctttttcagcataaaattccattaaatcatacacttcttttatcttttcaagttcctcatcattaattcgctcaattgctaattggattgctagcccttctaaagcataacgaatttccaacatatcatcgatatcacgatgagaaaaccctagtacataaactcctttattaggaatacttttaaccaaaccttctaattccaactgttttagagcctcacgaattggagttctagaaatattcaactctttagacaaagcaacttcatttaatttttgtccttgagtatattcctcatttaagattttatcacgcaaaacggtgaaaattttatttccaagcgacccatgtccggtattttctaataaattctttgtcattgtttaacctaactttctgatgatggctgcggtgaactcgtctgttgaagcactacccccaatatcaggtgttacaatagttccttcttcaactacagctgctaaagcctcacgcaatttattagcatcatctaatttccctaatgcctctaacattaatgcaaatgctaataataatgcactcggattagcgatacccttaccagcaatatctggtgcacttccatgaacagcttcataaattctaaattcatcaccaatattcccacttggtgcaaatcctagaccgccaactaatccagcacataaatcagaaacaatatcaccatataaatttggtgcaactaaaacatcaaaagtttctggacgaattactaattgcatacacatgttatcaacaataacctcttgtggctcaatatctggataatctttagccacatctctaaacgcttctaaaaataatccatctgtatatttcataatattcgctttatgaactgctgttacttttttacgtctattgttcttagcatattcaaaagcataacgacaaatcttttcactcgcttcacgagtaattaatttaattccatttgccatatttggattgatcatatactcaatccctttatataaatcttcggtattttcacgaatcataaccagatcaatgtcttcataacgagaattgattcctttaaatgatttgattggacgaacattagcataagttgcaaactgttgtcgcaaggcaacattgacacttctaaatcccgttccaatcggcgttgctgtcggaccttttaaagcccatttatattctttaatagcatcaacaagtcctggttcaaaaacttctttcgttgtagctgcatattcagcaccagcctgatattccacccattcaatgtcaagcttcatcgctttagtgatatcaacgacactctttgatatttcttttccaattccatcaccagggattaaaacagctttcattaaaattcacctcccaattctttaattgcatttaataaaccaccgtaattaatcattactttttcacgaggtgataatgttaattcagcctcgattgaatcattagtagtttcattaattacttttactttaccattatgttcaacaacatctttgatattaacgattttataactatcttggtcattgaagaaatcttggtctttagcttcaataactaaaggtaaaataccattattaattaaattggaacgatgaattctcgcaaatgatactgcaaagattgctttaatctttaaatagtttggtactaaagccgcatgttcacgggaacttccttgaccataattatcaccaccaacgatgaatcccccattattagcaattgcacgatcatagaattcaggatctactttactgaatgaaaattttgctaaatgtggcacatttgaacgatatggcaataatttgctatctgaaggaacaatatgatctgtcgaaatattatcaccaacttttaaaacaacttttccactaatttcatctgtaattttttctccacgtggaaccggtttaatattaggtcccatatatacttcattattttcgtcatattcatcaatgaagaaatttccatttttaataaatggggtatttggcacctcttctaaatacatatcatcttcaaattcttctgacatgtaccctttaattgcgctcaatgccgcaatttccggtgatactaagtatacgcttgcatcatttgttcctgaacgtcccttgaaattacgattaatcgttcttaatgaaatcccttttgagagcggtgcttgacccattccaatacatggtccacaaccacattcaagaatccttgctccagcttgaaccatatcagctaatgctccattttgtgaaagcatcgcaagaattgaacttgatcctggcgcaataactaaagaaacatgatccgcaactttgcgtccttttaaaatcttagctgccttcatcatgtcagcaaaagatgagttagtacaacttcctatcacaacttgatttactttcattccttcaagttcttttactggtactaccgcatctggactatgaggcttagcagtcattggcactaatgcacttaaatcaacatctaattcttgatcatatgtagcatcttcatcagctttcatttcaatgtaatcatctactcgcccttgttgtgctaaatattcttttgttctttcatcggtcgggaaaactgatgtagtggctcccaattcagcccccatattacaaatcgtagcacgatcagtcaatgataatgaagcaactccatctcccgtatattcaataatcttattaacgccacccttaaccgttaattgctgaagaatatataaaataatgtcttttgcacttacccatggtgctttttttccagtcaaattaactttaacaacactaggacattgtaagtaatatttacctgttgccatcgctactgcgacatctaatccccctgccccaatagcaatcatacccattgctccacaagttggtgtatgtgaatctgatccaactagagtctttcctggttttgagaagttttctaattgtaattgatgacaaactccattacctggttttgaaaaaacaatcccatgctttttagccacactgcggataaattcatgatcatccatattttcaaatcctgtttgtaacatgttgtgatcaatatatgccactgctttctctactgcaacatgtttaatattcattgcttctagttgaagataagccattgtacctgttgaatcttgtgttagtgtttgatcaatttgaattccaatttgttctcctggaacaagatttccatctttaagtttactacttaaaattttgtatgctaaattcatacccatcacgatatacccccattattcttatattgcatacaattatacaaaaaaacaatcttgattacaaccctttggaacaaattttaccacaagatgtactaaaaataaaacactttaataaaaatctattatttacttgatttaatcgagtaatttttaattacacttttttaataataaatttgtgaattcctaaaataaaatatctacttttcttcttaaaacaaaagccttactataaatatcaatgaaaatatgttagaatacattgggtgataaaatatgttaatagaatgttcaaatataacaaaatcatttcaagggattcccttattaaaagatataacctttaaaattgatgatcatgataaagtcgcaattatcggagttaatggtgctggtaaaactactattctaaaaattattgcgggcgaagaaaactatgatagcggtgaccttttttgtaataaagaattaacactaggttatttaaaacaacagcatgacttagcgatggataaaacagtttacgatgttggccttgatgtttttgcaccattgatcacaattgaaaatagactacgtcaattagagaatgaaatgacaactgatcatagtgaacgtattttaaatgaatatgatcgtctaactcaatcatttcatgataaagatggatatagttatcccagtaaattaaccggcgttttaaagggactgggctttagcgaagaagaattcaatttaaaagtttcaatgctatctggtggtcaaaaaacacgtttagctcttgctaaaatgctgcttcaagaaccaaagctattgttacttgacgaacctactaaccatttagataatagtgctattaatttcttagaaggatatttaaaaaattatcctcatgcaatcatcacagtcagccatgatcgttactttattgatcaagtttctaataaaattgtagaagtcgaaaatggaaaatccaaaagctataaatgtaaatataacgaatattcaattttaaagaaaaagcaaagagctgttgatttaaaacattatttaaatcaacaaaaagaaattaaaagaattcaagagagtatcgatacactaaaatcatataaccgtgaaaaacaagttaaacgagccgaatctaaagaaaagcagttagctaaaattgaacgtattgacaagcctgagaacttgccagatacaatcacgattaattttaaaccaaaacgtgagtccggttttgatgttttaaaaatagagaacctagctgttaaatttgatgaaattttatttaaaaacattgatatcgatataaaaaaacaagagcgtattgctcttgtcggggataacggtgtgggtaaaacaactctttttaaaactatcctcgatcagctaaatgcttatcaaggtaaaattaaatttggtagtaaagtagaccttgcttactatgatcaagaacatagcacactagcaatggataaaactatttttaatgaaattagtgataattttcctaagatgactaatactgagattcgcaacagtcttgccttatttaacttcaaaggcgatgatgtttttaaagaaatctctttactttctggtggtgaaaaaggacgtgttgtacttactgaaatattattaaaacaagcaaatcttttaattttagacgaaccaaccaaccacttagacattgcttctaaagaagttcttgaagatgccttaaaccaatttgaaggaacaatcttctttattagccatgaccgctatttcattaataaagtagcaactcgtgtgatcgaattaacgagcacaaaagccatcagttacgatggtaattacgatacttatttaaatcataaaagcgttgctaagccgctcaaaaaagaaaatgttgattatcttgatatgaaacagcaaaatgctctttatcgtaaacagcaaaataaaataaaaaagatagaaactaatatttctatactagaaaccaagatcaacactttaactgaacagcttcatagtgaagaagttctaaatgattatcagaaatataatcagatcaatgatgaaatttccgaattagaaaatcagttaaatactttaatggaagaatgggaagccctgcaataagggctttttatattcttttaactccaagaatacaataattttcatctacacctgagccttcacaatcaacatactcaacttttactacacaactgatatttgtttttcctagttttcgtaaagaaacacaatccccctgctcaattccctcttctttacaaacaactaaatggttaatcacaccgttacagattttatcaaaatattggctgtcaacctgtaaactacacatactaaaactcctttcaaatctttaaatattgtttatagtgatcagatccatcaatttcttcaattcgtatctcaatcgttttttctaaatcctctacaattgttttttcattaaccagatttttttgactaatccaagactgatatagtggataaattataaatcttaatgttaaagcaattgataacaatccgaaatctattgatacacctaatattaatggtttaagtaacattcaaccatacctcctagtattgccattcactcatgctttgatactatctaaatcacaataactaacacatatatatgctctaaataatttattatgtcagttaaataaaacattactactatacttaaccatatattgcattacttttttgtctaatctagtggaaataaaaatactttaattcttcaatccaaatatttaaataaaaaaagagcaaaataattaaatatcctgctcttttctattaaccgtttagtaattttatttaatcgatttctttaccagatccagctctttgctaatttccaataattccttaattgcaatttctagattttgtcttgggtgctcttctaaggacttcttagtcgtactaattctctcggctatgttttctaaactttccatgttaattctccctttttctttattctaccattttactatactctatcatgccatatttttgcagaccatatcagactatgataaattaaaaaaatgtccaatttaagctacattaatttaaattaataataataactttcttgctctccatgataatatacttttgataaagaaatatacaaaaatctcttacgattacaattataacaaattcatcacattagtccaagataaaaaaatttttctctagtttataaaataaagcaattattagaataaaatgcatatttttcatttttaaaggttatatttagccaatatgtattacccttacacttagtaaatctttgattttaccatccctctttagtgcttttttcatattttggaaaacggttccatttacattactttaaggtataataaagccgtaaaaacaaggaggaaataaaatgttacacaaaaaactaaaaccattcccaagtgattttttatggggagcttcaacatctgcttatcaagtagaaggagctaacttaatcgatggaaaaggaccatcttgtcaggatgtcaaaaaagtacctgaaggaacttcagaacttgatgtgtgtgctgatcaatatcatcgttataaagaagatattgcattgatggcagaaatgggattcaagacttatcgtttctctatcgcttggacaagaattttacctaatggaactggtgaagtcaatccaaaaggaattgaatattataataatgttattaatgaatgtttaaaatacggtattgaaccattggtaacaatgttccattttgatatgccggctgctttagatgaaagaggaagctggggtaatccagaatcggttgactggtttgtaaactttgcaaaagttatgtatgaaaattatggtgatcgtgttaaatattggctaacgatcaacgaacaaaatatgctgactttagttggaccggtaattggtacattacacttgccggaaggatgcacaaacgaaatcaaagaaatctatcagcaaaaccatcatatgctggtagcacaagctaaagcaatggcattatgccacgaaatgattcctggagcaaaaatcggacctgcaccaaatatttcattagtttatcctgcttcttgtaaacctgaagatgttctagcagcacaaaactataatgctataagaaactggttatatttggatatggcggtttacggtgtatataataatttagtttgggcttacttagaagaacatgatgcctgcccaacatttgcacctggagatgctgaagcattgaaaaatggacatcctgattttattggtttcaactattacaatactgctacttgtgaagctagtgatggaactgaaacaatggatcctggagctgatcagcaaactgctcgtggtgaagccggattctatcgtggatttaaaaatcctaatttaccaactactgaatttggatgggaaattgatccaatgggattccgggcaacaatccgtgaaatgtactcacgttatcgtctgccaatgatcgttactgaaaatggactaggagcatatgataaattaacagaagacggtaaagtacatgatcaatatcgaattgaatatttaagaaaacatcttgaacaggtacaattagcaatcacagacggttgtgaaatgatgggatactgtccatggtcagcagtagacttgatttcaacacatgaaggtatggtcaaacgttatggatttatttatgtagaccgtgaagaatttgatttaaaaactttagatcgttatcgtaaagattcattctattggtacaaaaaagttattgccactaatggtgatgatttatcagattaatttaatcttaaaaagtcttctatagaaatctatagaaggcttttttgctaataaatatagtattataacaacatgttttctatttaatttaagtaaatttgctaatctacaatcttttcaaataccgggtcataactaactaattaattattgtttcaccttcttgttgcaattattttaacgcttcaatcacaatttatctattattctgatcaactgcctaagcctgctcacccaccaagatttcttcctctgaacatttaatatccttatatccttgtagtgtttgtttatataaagccatttttatttttccttctcatttcctttttcatattctaaagctaattttaaatcatattccattattttattttctattaaggcaaaactttgaaaaagcaactaatcatttccacttttctagcgaatagcttaatttttttatcaaataaaataatattcccacttgttaatgaattcaatcattcctttaaaataggattcggatagatatatttaatgctgataatacagcaataaaaaaacaatccctctttatctatatctgaataatgagataaaaagcaagaaaaataacttttatttaatgaagacatcatgtttttaatactaaaattattattcctatataataataaaagaatcggctgtaaccaattcttttattctacatcttcttcatatttaataatttcaccagtatctgcattaatttctaattcatattccttattaccatttttaatctctatctcatattttttaattccatcatcgtcatcataatctaactctgtttttattaagtaaccaccaccaacacgatcaaaagcgattttttgagcttcctctaaagaaacagccgtattaacaggagtaatcggagtaactgttccatcaactggattagttgtcgtacctatataatcatcatctttttcccgttttaatacctttccactatttgcgtctacttctatttcatacttttctgtatcagttataatagtaaaatcatagtaagttaccccatcatctttatcttctttagccttaaggatttttccttctacttcttttaaagcaatttcttgagcttcttccaatgttagggcactaactttttcagtacatccaactaaagctattgtaattaatacaaataaaattattttcttcataaatattatctcctttcaaaatcaattgtaaaaattgtatattgatcaactatactttcaaccgtaattgcatagtcataatagctgcaaattcttttagcaattgctaaacctagtccaaaattgttattattttgagcccgtgactcatcagcccgataaaagcgattaaatatatagtctaatttatctgcttctatcccaatcccgtgatctttaaccattaatttttggtcaacatataataattcaattttcttttcttcttctcttgaatatttaattgcattatcaattaaaataattaaaagttgttttaaatgttctatgcgcatccatatctttgaagttacagttattttaataataaattcaaattctgggtgaacttctttaaaatttgtaattacttcatcaactactaaattaagatcagttggttcttcacaatgaatatccatctctcgggttaaatgaagaagttcattacacaattggattaatcgctcaacttcattactagtgacattaagtgaattgctaagaatagcaggatcatcttttccccaccgctccaacatatctaaatttccttttataattgccaatggcgtttttaattcatgtgatgcatcacttacaaattgattttgttgtaataatgatctttccacttgatcgattgtttcattaaattccttgcctaataaagctaattcatcatttccctcaataacaagccggtgacttaagccctcatttttaatttgtttaatactctttgtaaattgatcaacagtttgtaaaaaacgtttactaatcatgaaaccacaggcaatactggtaatcaatgcaacaataattaaaatcaaaaagattacagcaacaatactagctatgggggttatcaaatcttcatccattgcatagattcgtccaataatcaataaataataacccatataaagtaataaaatcaagctaaatactacgatcactgtcataataataattgaagtagtactaactaattgatgtcgtagtgatttaattttcatgataaacggtatcctactccacgtactgtttcaattttaattccgggaattttattacgtaaataacggatatatacttcaacgacatttgttgatacatcttcatcataaccccaaacctgatctaaaatcttattgcgactaacaacatcaccgccattttgaactaataatgataataaatcaaactcagtcgttgttaaatttacttcattatctttgaaaaagaccttgtgcttacttggatcaattttaacttctccataactatattcaagaagtgctttttgaaagttcattcttctcaatagtgcatttatcctcgctaataattcttccattgcaaacggctttgctaaataatcatctgctccaacttgtaaaccattgaccttatccatcacctcatcacgagctgtaagcataattactggcgtttgtttaatctctcgcaagcgtcgacatacttcgattccattaattcgcggtaacattaaatctaataagattaattcatattcttgctctaaagctttttttaacccaacttcaccatcataagcttgatcacaacaataacctgcatgggttaattctagctttaatagatctgacatatttttttcatcttcaattatcagtattgccatcttcatcactccttatattcaaatccaattatctttccactttttgcactaatatttatctcaatcagttcttgctgctgattctctatttcaagatggtaaaatatttgcatatgctcatattcaatttgtgaagatacgatagttcctggaaattgtttcaatgctacaacatgtgcttcacttttagaataattaatgttatttaaagttgtatgtaatatatagacaccaaaacaaataacactaatgacgattattattatagttgttataatttgttttttataaataatcagcttttccattcccatcttcctttcatctatatcataacctattttgcccgattgttgcttaaagaacaataataattaaataagaattttctcattttctaaaaataaataagtgtgatctaaaatcacacttactcaaacaaagcaaattctaaataataaactagatcatgaaacattctagtattaaagccataacagctgcaatcatctatttctccatcccaatcattatttaatcgttctaataacagcggtacctctgtaacatctaaattaactgttacaaaaaactcactacaatctttttttccagcatactcacgactcggtgaaattgaaaaattaggatttatttgtaacaacaaatctttaatcatttgataatcttttatatcttcactttcaataattacatataatctcgctaacatataaccacctctttcctgcctattttatcataaaatattgtttagataaaagtatgctattaattaattttattctgattatatttactaataaatatgttaagataaagtaaagagatatatttgaaagctgggataattatggatgaatcactaattacgatcattgggtttattattggaggcctatctatctttatttatggaatcaatcttatgagcgatggcctcaaaagtattgcaggatatcatatccgtgagtatattgaaaaatatacaagtaatctttttacctcaattttagtgggtactttaatttctgcaatcctccattctagttctgctgttacagttatttcaatcagtctggttcgggccggattaatgaagttggaacaggctataggaatcacgattggagcgaatattgggacttgtgtgacttcaataatgataggcttgaatgtggaacaatttgcttactatcttgtctttattggggttgtaatcatgtttttagctaaaaaaaagacgattggatacatcggcaaagttgttctgggctttggactaatttttgttggtctacaaataatgagtgatcaaatgatagcctttgctaaagaaccttggtttacaagtatcatgacaacgttaggaaaaaaaccatggtgggcacttctaggtggaactatagcaacaggcatcatgcaatcatctactgctgttatcggtgtagtccaaaaactttttacaactggttcaatcactcctgctgctggtgctgcatttatttttggggccaacattggtacttgtattactgcggttattgccgctttaggcggatctatttcaactaaacgagctgcctggtttcatgttgtttataatctagcaggtgcaataataggaatgctcgttttaaaaccattcgttaatttaactaattgggtcaatttgctgctaaacggcagtcaagaaatgtatattgctcaagtacacttcatttttaatatagcttcaactattttagttattccttttgttcgctattgtgttattttattagaaaagttaattcctgggaatgatcatcatgatacgctcattgaaaatatcgatgagctagatgatactttaattgacaaacttcctgtcggagcattagcagttgctaaaaagaatacactccgaatgggacgaaatgttatagccaatattaaattatcttatacttatttaatctctaaaaatagtgaagattatgatgaaattatcgaaattgaagcactaatagataaatatgattctcgtttatccaaatacttgttaaaaattgctcaacagcccacattagcaaaaaagcaaactaatgaatactttaaaaattatcaaattatcaaaaatcttgaacgaattggtgacattgttagtaatttagctaattattacaaacttgtttacgatgaaaaaggtaaattttctaacgaagcaatcgatgatttaaataaaatgtataaattagctttagaaatggtccaagatgctctagatatttatgaacacgataatgcaaataaacttctttcttctttaaacaaaaaagaacatactttaaatgctttagaaattgagtgtcgtcaaaatcatctagtccgaatgcgtgacggtatttgtgaagataatatcgctgcttctatcatcattgatattatttctagtattgaacgaattggtgatattgctttaaatactgcaaattcaacaattacggtatacaaagatcataaagttaaatatttaaatgtttgatttttacataaaaaattactggaataacatccagtaattttaatttattgcatctttatcggtttcaccggttctaattcgcaaagcactttttagatcataactaattattttgccatctccaggattccccgtaaatgctgcggtttgaattgccttgattgtcttcttttcccaaacttcatcacttactataatttcaaatttaatttttggtaacatatttatttctacttcattacctctaattacttcacgatagcctttttgaattccacaccccataacttgataaactgtaatcccatgaacttcaattttagctaaagcttctttaacatcctcaaacttatcttcacgaacaaatgcttctattttaatcacaaatcactcctccttactctaatccattaaatgatgggtatgctgtctcattatgttcagacatatctaaccccatctgttcatcacgtttatcaactcgtaatggtgtaaatagccgtacaactcctatacaaattaaagtacctatcacagcaactactattgttagtaaaatgctaataatttgtgcaattaataagtttgtatctccgaagaataacccattccatctagctacatcattgattgaagtttgagcaaaaagccccgttgcaataccaccccagataccacctattccatgacatccaaatgcatctagagcatcatcatatccaaaatattgttttgctttagaaatcataaaatagcaaattggactaccaacaaaaccaataataactgcagaccaaatcggaacaaatcctgcaccaggagtaattgctacaagcccgacaactaggccggttacacttcccactaaagttggtttattaattttccaaacatccatcaacatccatgataacattcctgaagcagcagcaacagcagttgtcataaaagcgtgtattgctaatccgtcagcttttaaagaacttccggcattaaaaccaaaccacccaaataatagaaggcttgcacctagtacaacaaacggaatattatgaatacgatatttcgcatgatcataatccttacgtttacccaagataatacacaatactagcgcgcttactccagaactaatatgaacaacatttccaccagcaaaatctactgaaccaatttcagccaagaatccccctaatccccagaccatgtgagccataggataatagacgattgttgaccagacaattataaaaataaacaacgctttaaacttcattcttcccgctacagcgccagtaattaaagctggtgtaataattgcaaacatcatttgaaatgctgcaaagcctaaatccggaatcgtactggcataattacctggcgtcgttcctacattactcaagcccaaaaagcttagatccccaattattcctagatgatcatttccaaacgccaaggaatatccaaataatatccacataaccattgctattccaattacaaaaattgaagtcatcatcgtattaaccacattttttcttctaaccattccgccatagaaaaaagctaatcctggtgtcatcaataacaccaatgctgtacagattatcataaatcctgtatctccagaatcaatcatatttcttccccctttatttatgattatattggaagtatagatgatatttttttattaagcaagatattttttatcactaattattttcagtttaccttgtcgtaaaaaaacattgatattatcatagttttttaatttgttaaaatattgttatttttatatatgataaaaatagttattggcatataagtttccaattaactcgttattgtatattagtgcagttattattaattcatttaagttaaaaaactatagatcattacaagataaaattaaataattgtcatttttaaactgtttttccataaccaacatagaatgattcacaaaattatttttaaagtattcttttgaaattaaaatcactcctataaaagttatacctgtgactattaatcatatatataaatcatttggcacagctctaattagaactgctccaattacaaagtaaaacaatatatatataattagtatcttagataaaatacttaatccttttatctttctatttaaaataaactatataaaaatcatagcatatctattttataaaaaaggcataattttttcacaaaactaaaaagagctgtaacattctaaaatagtaaaaaaactactcactagttacggctacttctataagtatatctccttctttacttggctctatagctatcaatctattaacttttttgcacaagtgggacatgcaacataaaagtaagtacatccgttttcacatttataatctattattttaaaactactaacttcagtatcaatgctctctttagttactatctttttcattattttcccgtcaaaagagatataaaacaaaaactatatcacttttttatgccttacgttaatattaatcaaaaaataattatacgatattttgttctattacattaataatattgtatctattttttatcgtagcaagataaattttgtagtatattcttgttttcgtaattttcctaaaataatatatttgctaattattcaagaacttttctatatcttcataattagatatttctatattaaaaacatatgaaaaaaatttttgcaattcacatatatcatattctttaaaatttattttatgtatcttttgatacacttcttttactaaaaatcttaaatctgaaatataattacaacatactaaatcaacaacatctttaaaaatatctctatgcataataacctatcccctcaagctttattcacaaacattttaaatataaatactgaattaaaaaatacatcaatcaaataaaccaaaataactctccaaaatttcaatacaatatacaagtaaatacctttttaatatcatattaaatttttaataatattttttcccaaaaatatatcctatatcaataaaatttgggaacaatttaatcacataattatcatattatatagttgtaaaaactataaatagcttaagttctgttgtaggtggtgaattatgcttgactattttttagaaaacactacaaaaaagaaattatatcttttttccatcttatatttaaagagagtcacttctgtaaaagaatgtaagtatatacttacatttagcagtaccagtataatttcaataattaacgagttgaattttgatttcaatggaattgcagaaataaatataacaaattcattggaacttaaattaattgtatacgaagatattacattttctgatttactccatgctatataccaaagctctaatgtattgcattgtatcaagtttatgataaccaatgaatcaaaccattcttttttgatatttgcggaagataactatcttgcaaaatccagtgcatatcgaatacgacaaaaatgtattaaatatatccgcagtatcggtttggatattaaaaaaaataaagttataggggaagaatacagaattcgatttttgattgctcttttatactacaaatgcggtatagattgttgcgatattgatgaatattcaataaaacttattaaagaatttattatatctactaaccagtcaattacttttgaatttcttaataacgctacaaatgaatatgattattttgaatgtctaatgtcacttttgtggaaaagaaaagaccacaatgacaatttatctataccaaaggagcttgaaaaatttaaagagatttttatatacaatgatttgaaaaaatatttacataatgtaattgggaatcagcttaacatagatttttcaaaaaaagactatgattatatgtatttagtttatttttgtactaataacttcctttttgccaaccagtggacagaggaacgtaaagagcacatttataaaatatttctttccaatcaaaaattttatgatttatatattcgtcttagtcataaatatggtaaatttctagaacaatctcacattttcaaaacaattttaatctatttttttaaggatcatctttttcaattacaatgcctaattccaaatcagcgtctatatatagatactacacctactacaacttacatcaccaataatgacgtatcaggtatcataaattcatggaaaaaggcaaataatatattatatccaacagataaaagaagtatattctatttaacaacacaaattgaatttatattaagacaacttgttccacctgtaacaatcatattgttatctgatttaatgtccgagatagaaatgataaatctttttcttgaaaaaaatttttcccgcaatcgaattaatataactccgttacttttaaacagttataatttagaatatctgaacgctgaaaaaaatagaataataatcattactcgaggaattgaatatttattaaaatcatacaatttctttcaaaataatactatagtaataatagattctagaacaaccttatacgagaaagaaaaaatttcgaatgctattgccaattatgaagaaaaacaatttctaaaaatttgtgctggaacaagtcttactgatacagaatattaatgatcaacataagtgcaacagtctatttatacaaatattatattatttaaatagcatattttatcttaaacttatttcttggcaaaaacacttaaatcaaaaaaggactgtaacgaataaaaattttaatctttgacatccccccttctaagtgacaattttttattatttcacttgtctacctagaaggaagcatatcatttaatccgttacagcccctttaatcatatactaattcatcttgatttataacctcttcatcagtaaaatatgcttgagtttgtactatgacctcttttcttaatccaattaaaccaattaaattagggatagccatacaaccattaacaatatctgcgagaataaaaataaattctaatgacataaaaggaccaattgcaataaagacaatataaataaatttataatatggaatcgcttttaaaccttttaaataatacatacatctctcaccataataattccaaccaattatagtagtaaatgcaaagaaaattaatccaatattaacaatatacttcccaatcataggaataaataaaccattactaaatgcttgtgtagtcattgcggcaccttctaaaccactagtatggctattagtaagtaaaattgcaattcctgtcatggtacaaataacaactgtatcaataaacgttccagtcattgataccaatccttgttctacacatgaatcagtttttgctgcagcagcggcaattggtgcacttccaagaccactttcatttgaaaaaattcctctactaattcctttttgcattgccattgtcatagtaatacctataccaccaccaagagctgcttgaggattaaatgcactatgaaccactaatacaactgtctgcgggattaagttaaaatgagtaattaaaataatcacaacaccaccgatgtaaagaatacacatcataggaattactttttctgctacattcgcaattcttttaatcccgccaattgtaataaaacctacagtgatcgttaataaaaccgctgtaacaattggtggaacattaaacgataactccattgcatcagaaattgatttaacttgagtaaatgttccaattcccaataacgccacagcaactccaaaaaaagcaaaaatcttagctaaccatttacttcctaaaccccgttctaaataatacattggtccccctgccatttgattattttcatctttgatacggtaacgaattgctaataagccttcagcatattttgtagccattccaaaaaaagctgatacccacatccaaaataatgctcctggtcctccggccgcaatcgcggtagctactccaacaatatttcctgtcccgatcgtagaagatagtgctgtacaaagagcctgaaaacttgatacatcaccttcatcattatcctgttttttaaaaatacacgaaaacgctaatttcaatttcgttaattgcaacagttttagcttacatgtgaaataaattccagttcccaacaatagacaaataagcggtaagccccatacaagctcatcaatttttgtaagtaaatttgtaataaattgcataaaaaaactccttcttaaaataattaagtcggaattaataatgaaaaaaactattcatcccactgtccttttacctgagagtttcacctataaataggcttgctccttcggtgcttaatttaataagtctctccagaggttcgtccaatagcgatccttttacctgaaatctttaattcttcggtgttcaattagaatctctttcgccattatcatccgatatatacactaagattatacgctaattgtatacaattgcaaatattttttatttttgcaataaagtatttgtaaaaacgacatttctcttctataataacaattatgaaaaaattaaaatattttattcctgccctaatttggatgatctttatttttataatgtcacacactaatggtaatgactcttcaaatcaaagtaattttattgctgaaataattttaaaagttattaatattgatcgtgatacattaacttttataattagaaaagccgctcatatgagtgaatatgcaatcttattactcttactttattatgcactaagtaacgttatatctaagcatactttatcattatcattattagtcacatttatttatgcttgtagtgatgaatttcatcaattgtttattccagggcgcagtggacaatttaaagatgttctaattgacacttctggtgccttgatcatgcttatgatcatctttttatggcaaagaaaaaagaagtctaaactaatcaaataactttacttaagttattttgattaatcattagacttcttttcattttgcagtttttcaatactttcttttaacttatcaatggcatcattaagtacatcaagatcattttgatgatcatcgttgtcatcatcactcggtggcgttgagcgttcttctaagacagctgaccaagaagagtttgaggctaaaatatcacctacaacattaaaccatgctcccaaagcagcttgctcactcgtagtaaaatcatttgtcaatagatatcctaagatcactgcagttccagtaaaactatacggatcaagattgggtatatacatggttcacctctcccatattttaatatatgctaaataaaaaaaaacttaggcttttgcatatttaatatttcgctgcacacactattattgggtgaaaaaatgaatgataatgtaaaattattaaactttatttatcaaaactcgcaaatgggagttgaaacgattgagcaattagaaaaaatcgttgaagataaagactttaaaagatatttaaaagaaaaatatgaaggctattgtaaaatccataaagatgctaaagaaaagttaaatagtcatggatatgacgaaagaggaattggttcttttgaaaaaattcttacttacttaatgatcaatatgcaaacactgaccgataaatcaactagtcatattgcagaaatgatgatgattggaagtacgatgggaatcatcaatgcaattcgtaatatagctgattacaatcatgctaaaaaagatattattaagctcatggaaacattaaaagctttcgaagaaaaatcatatggagatttgcaaaaatttatttaaattgctgttaatgcagtgctctcctaagttcaactttgtgagggcactacatatgaggtatattatttctaattaaaaacagtattacaaataatactgtttactatcactaattataatcaattaaaccaaatttcttaaacactggtttttgcaatttcataaaaatccccatcattggaccaaataaaaacattccaataatagttccctctcgtactgctaaaggcacatcagtaataattacaattataattactaataaaattgaaactacgtcaaccccttgccgtaaaacatggaatttctttccagtaactccgctaacagccatacaagctccttccaaagcaaatgtaacaatatctagaaccattaccattcctactgcaaaagcactgacgatatatcccaaaattaataatccaacattcatccaatatgtattaatcgtaaaattactgtatacttcatacaacatgaagttaacaattagccctaataagatgcaaacaggaatttgtaatagctggatcggcttaaattttcttctaagtattgccacttgaacaaagatacataaaaaattacaaaacataccaattgttcctacctctatccctgtaactaaactccctgtctgtgccaaagcatcccatgcacctactccaatggccgctttcaaggttagagctgaactacatgcaacgaccacaacgccaaacaccaaaactattacccgcttaaacattttaattagtacctcgctttttttgtataggcattattatagcggtttcaataatctagtcaacctattttttaagcgttttcaaaaatagaaaaagggtaatctacccttttaaaataactctacttcttgtatgagtgcaattagctcgcttaagttattaattacataatcagcaccagcatctaaatatgcttctttaacccgttcaattgcacgattccgttctttaggtgttaaagcattaaattcttcttcgttcaatcccaaagttgaacttccctcaatgacaccaactgcgattacccctgcattaacgccttcttgaatatcagaaattgtatcaccaactttgattacattttttacactgcttatatgcagttcaatcatatttttaaaaatcatataaggataagggcgtccaaagtgattagtagcatcaggtgagtaccagcaatcaggttgatacccctgctccttggcactttttaatactggctccatcatcatatctgtatatccagtagttgagccaatcttaattcccaattctcttagttttgccacagtttctaaaacatacggcttaacatctgtatgttttgtaatacctgtcattaatgatgcctcaaataaatcataaattttatgtatatcctgttcattaaattcacgatcatatctagccttaaatgcttcattcaatactggcatttctaacattgttttaatatgatcaatcttcaacatccccattggttctctaatttggtcattagttggctctaatccataattattaaaagcatctttaaatgcttgaacaggagcaaaacaaccataatcaactgtagttcctgcccaatcgaaaattactgcttcaattctactcattatgctacctccgctaaaaaatctttaataattgaacataaatttaatatatctgcttcataaatttcaccaatattaccaattctgaatgtttgagcagtagttaactttcctggataaattgcataaccacgtgcttttatataatcatacatctcactaaaagcaaattcttttccttcaggataatagaaagtagtaataattggtccttgataagctaaatcaacatagcttttcattcccatttcagccattttttcaattagcaaacgattattatcataataacgtttacttcgagcagctattccaccttcttccaacatctcatctaacgcttttgaaaatgccagtacaacatgggttggtgaagtaaaacgccattttccatctttatccatcgtttcccattgatcatataaatccaatgataaacttcttgctttacctcgactagctagtaataaatttttattagcaatcacaaatgaaaaaccaggaactccttgaatacacttgtttgcgctacttataataaaatcaatccctaattttcctacctcaatatcaacaccaccaaaactactcatagcatcaacgataaatactttatttctttctttaactacttttgctacactctcaatatcatttaagatcccagatgttgtctcactatgaacgatagcaacatgagttatttctttttcttcatctaatttttcagcaacagctactgcactaggattttcattttcagcaaactcaattatctcatgattaattcttgcgtgctcacatatatctttcattctttttccataagcaccattagcgacaatcaacagtttttcattttcgccaattacacttgtaattactgactctactccaaaagtcccgcttccttgcatcagtactacagtatattgctcagctcttacatgagctaattctaataattggtccctaatttttaaagtaatttttttatagtcatcatcccatgtacaatgatcaaataacatttcttgctttactgttgctgttgttgttaacggccctggtgttaataatttataatctttcattttcttctcctacttacattcttctgataatttttgatgtttttctaataattcggcagtcaatttttcactaaaagtttttggatatgctgacttatttgcactatcactagtttctccttggtaaaggggattagggtaggtttctaacagctctttacgtccactttcaataatacattgtgccatcttcattgctaatttttgatgttcactaccatctttatttacgactgcaactgattcagtcaaactaaaatttccctctgttgggtcaacaaaatcgattggaagtccatcagctttatcacgtaccgcctgatgacgtagaccaaagccaatcgctacttctccagctcgaacttttttaattgggcctgatcctgaatcttcgatatgtgctccggcattatcataaattccttttaatacttcctttgctccatcttcgccatattcacttactaatgcctgaattaataaccatgctgttgatgaagatgctatatccgtaactgagatcatatctttgtattctggcttagctaaatcttttaaacaggttggtgtttcaagactatttgcttttaattcttcagtattaataataatagccccttcttgtgaagtaatcggtgtgtaataagatggatattcatctaatgcttgagtatcaaaatctaaatcaacaaacatctttttttgttcttgagcactatcaagataaaacgagctcattgttactagatctgcctcaatattagttccttcagccaataacttacctcctaattcagaggttccaaaagtctgaaataaatactgtccctcataaccatttttatctaatgcatttttcattgccgttacagcttcatcatcggcatttgaataaataacaacctgatcatttgatgaagaacatccagttaaaagtgaagcacaaagtaacgaactaactactaacccctttaataatttctttttcattttaatgttttcctttctcttctttgcttactaaagtaactaaatactcctttagctaataaattaattaataaaatcaagattgataaaacaaagatttcattaaatttagcaaaatgctgtaactctttgatctttgtcgtcatcaccatcgtccgcgccccagcaataaagataaccgcactaacagtgaccatagcattaataaaataataactaaatacttctaaaattgatgaaattgcattaggtgtaataactctaataaccgttttaaaccagctatcacccatcagtttcgcagttgtttcaaatgaaccattcatctttgtcaatgagtttttcatcattaaatatggcgatgaaaagaaatgaacgatattacacaaaataatgatgatataagtattttggagcactgtcccagagaacattaacaagtatgctatccctaataccataccaggaatagtattagtagctagagcaatactttcaattatctttttcaaaaatttatttaaagtgctccgggcactagccagcgctgctccatatacgacaagtgttcctagtaatgctgtaaagattgcagtgattaatgaattttttattacccctagcaatgttgcatcactaaaaacattaataacattttgaaaagtaaaactaattcgatatggccactctccaacaaacggcacaattataattactataaagacagcaataataattacattaatcgttatgctcaatgtcccccaaaaccaatcacgaaaacgattctgtttgatttcaatcgtagagattttattataacaaatattatatttttcaagccgatgcaataaaataatactgatgattgaaggaatcagcattgtcattgcaacaactgccccacctgcaaaatttggaatacttcccaacatcttattgtaaagtacactagcaacaacatcatactttccacccaccgatgcaggaatcccaaaatctgtaaaacttagaaagaatgactgaataaaggctgcaaccaaagttcctaataaaggtcgaatcaaagtaatcattaatgtcctaaattcactatctttcattaatttggaaacaataataaattttttatcaatgtaactaatagcgttattaattaacataaaagcaatcggaaaagtatatataacataccctagcatcaatcccttaaaaccatatatatcaaataattgaaaaccaaataactttgtccacaacccttgttttccaaacgaatagataattgcaaatccataagtaatggtcggcaacaacattggcagcatcgaaacattattaattatccttttcaaccctttaaacatattcgtataatttaaagtgtaagcaacaataaatgccagtattactgttactagagcactcactccagaaacaacaaaactattttttaaagcatgcataaatcctgttgtttgataagtttgtaaataattatttaacgttaaacctccattattatagaaagattgtattaacagtgacccaattggtaataacagaaatatcccaaaaacagcaataacaattatataaataaacttgatttctcgatttttattcatttctttataccaccggactaaacaaagtcataatatttcttctttttatttccagctgatttaaaatgaagtcttgaacaaaatcacaacttggatgattaataatttcctctggtttaccaaactgagatatttttccttcattaataatcaaaacttgatctgataatgttaatgcttcctctggatcatgagtaacaataatagtagttaaattgtactccttagcaataatcttaattcgctctttaatagattccttgattactccatccaaagcgcttaacggttcatctaaaagaagaatcttaggtttcattaccattgttcgagccaatgcaacccgttgtttttgtcctcctgataattgatcaatctttttatctaaatgcttctccaatcctaacaagtgtatcagctcatctacttcttctttagttgaaatatccggtttgttctttaaaccatacgttatattttcataggcatttaaattaggaaacaaagcataatcttgaaagacaatattaaagcctcttttttccattggaacataagttaaatcctcattttcaaaaataattcgtccactatcaacctcactaattcctaaaataagatttaataaagtagttttcccacttcctgaaggtcctaaaattgaaacaatttgccccttaggtatctccaaactaagattatttaaaatatttataccatcaaatgacttaacgatcctttctagttttaacattctttttcctcctcgaacaactgcattatagctaactaaataaatttctatctattcttttttctttaaaacttggttaagaaagcgttaataaaaagaggtggtagatgtagaaaaactacattcacagctcctctttttgatatccacgatgtttaattaatctactatagtgatctagttttttagtgtaattatcataatcactgataatcacacccatatagatcatatcgactaatgcaatttgagcagttcgtgaaaaaattgcatctccatacaaaaactgatcattacttgttgataaaacaatatcaccatatcgagttaacatggtattttcaaaattaacaatagcaatcgtttgagctccagcatctttagcaatcttcaagacttcgactgtatttttagaatttcctgaataagatattccaatcgctaaactatcccttgtcagattacttgcatcaatactttggagatagtaatcactatgacaagtaacactctttcctaaatatattaatttagtcattaaatcatgagctacacccattgaattctcaacagcatatattgaaatatgctgactttgattaattaaagctacggttttttgataattcactaaagaaagagattttaatgcattttccagcatcgatgttgctgtagctacaattttacctggaagatccataattttatcatcggcgtttattgaaaaaccatataaaatatctatattattttctttatcataatttttagctaactctaatttaaattgtttgaaactgtcatagcctatcgctttaacaaaacgcattacagttggctgcgatacagcaacttctttggccaataacgtcattgataaatcttctagctttccacaataatttaatatataatcagctacctttttttctgatggacgtaaaatattgtatattgtttttatcctaaaattcactttgcttagcatattctctcctgtagtatttctactttattttctctttttatttatttttagtataagcaatattaaaaaaagctactatcatgctagctttttttatctaaagaaaaagtaatttttttgttaagaaaagaaaaaaccagatttttatctggtttttagattactaaggaataattattcctcgcgggttatcaagattatattctttagcgagcttaggaaaatgattatcaaggtatttttctaatgctgtatcatccaaacctttagtaagaatgtcttttatttttaagggatcattaattgtaattcctttacttgataatatctctatgatagaaacaatattttttaaactataagcctcaatcattattttttcatcatctaaaatgatatctagatccacataataattaagatgttgtccgactgctaaggtactaccataagtccaccttttaattattaatttttcaagattagactccacaattcctggattatataagcgtgaacacatcgatacgttaatctctttgatttcatcgaatgtaatctttctaattttattatcaagtcttaagattaattcttccccaatcaaaagatactcctcttgttgatcacctagctggtcaacatacacatttaatcgaacacgttcactttcctcataattaataactcgactaattttgttcagaacatcgtgtttcattattatcccccctttacacttttattaaacactatggtctaaaacaatagtcaagaaattctattcaaatatttattaattcaataaatactaattttataaaacgctatttagtatcgaatatatatactccatagattcttttaattaatgttttcttttcatcgaaactagaattgctagactaggtactaagaccaatctatatataataatatcatcacctgtagcaattaatcttttgatcgttgaaatagcatttttagcaggatctatcgtttttagcataagtaaaccaaattgggaaagctttaatactttcaatctgttcatcagtaattacactatcttcatacacttcgcaaattgggaaagctatggcaaaataatctgagtgttttaaaatcatttccattgtcatataattaccatttgaacagcctcaaataataattcactaacatgctccaaataactcatcagcataaatagaattaccaacttgataattattattgcctccatcctcattgttgaactttgtagcactaaaatatattatatagataaaaaaatcctttgagatataaatcccaaaggaaatattattaaattccaaataataaatctaaatatgttggcattggccaatattcagcatcaatagattcttcaagctgatcaactgtttctctcaatgcttgcatcattgcaaaaacatcatcgcgccatgcaactgcctgttcaaaaatttcttcttcagaagcttgagctgcagcaatattagtttctaaagttgtcatttgttctttcattgtcttcactaatttagctaaagcattagcatcatcaactaagaaatcaacatctaaacctgcttccttagcagcaatcacttcagaagatacttttgataaataatcacaaactgctggataaatttgagatttggccatttttaacgctgttaacccctcaacctgaatagttttaatatagttttctagtaatatctcataacgagatcctaattcaactctactataaacccctaaacgatctaacatctctaaattcttttcttctttcaaacattttaaagcatcaacagtatttttattattaggaagtccacgttttgctgcttcttcttcccattctgctgaatatccatcgccattaaaaataattcgtttatgagctaaaacaaattctttaactacatcttcaaatgatttgcctgattcaatttcatcagccattttttccattgcgtcagctaaaattgcatttaaaatagtatttggtccagcaacagattggcttgaaccaactgctctaaattcaaacttatttccagtaaacgcaaatggtgatgtacgattacggtctgtattgtcttttgagaaagttggtactactgatactccagtggcaaaacgtgccgcatcagatttgctagttttcttaccttcacaaatttctgctaaaagagcatctaactcttcccctaagaacatagaaataattgcaggtggtgcttcatttgctcctaaacggtgatcgtttccagcgctggcaatactcatccgtaataaatcagcataatcatcaacagctttaatcgtacatgcaagcgttgcaataaatggtttattttcagcaggattagcacctggattgaataaattaatacctgtattagtaatgactgaccagttatcatgtttaccagaaccatttaccccagcaaatggcttttcatgtaataagcagcgtaaaccatgctttttagcaatatcttgcataatttgcattaataaatggttattatcagtagtaatatttacttttgaatatacgcatgctacttcatgttgtgccggtgcaacttcattatgttttgtttttgaaggaattccatatttccataattcatgatctaaatctttcataaaggcagacactttacgtttaagactaccaaagtaatgatcttctaattcttgtcctttcggcgccattgccccaaatagagtacgtccagttaactttaaatccattctttcttggtaatatttatcatcaactaagaaatattcttgttcagccccaacagatgcagtaactttagtaattcctttttcaccaagcaaaggcaataatcgacatgcagctttagataatgcatcacaagatcgtaacaacggtgtctttttatctaatgcttctccagtatatgaacaaaacaaagttggaatatataaagatccatctttaacaaatgccggtgatgtacaatcccatgcagtatagcctctcgcttcaaatgttgctcgtaatcctccagacgggaaagacgatgcatcaggttcaccttttcttaatgtttttccactaaattctaatactgctttacaaccgtcaggttccaaaaaagcatcatgtttttcagctgtcaaaccagtcattggcataaaccaatgggtaaaatgtgttgcaccattttctaatgcccagattttcattgcattagcaattactgttgcgcattctttagataattcttcaccattatctaaagactcatggaatgccttgtaaatagatttaggaatccgttctttcattacatcatcactaaatgccaagcatccgtaatcttctaataacttattcatttccattctaagttcccccttgttagtttctaaacaacacataaccatacacttaatatatgtttatatgccgttattatacagttactttatttaggtgtcaatatctatatgatatttttttatcattttgttaattctttattaaaatgataaattatttataactgtttacttaaagatacttattacaactaagtaatattccatttttacaaaagaaaaagatgcttattcagcatccatatttgcttttttagcttcttctttcaaagctcttttgcgtttcttttcatatgatctatgagtagctgcatattcagtacattgcacatgaattcttttattagcagctacaatcgcttcaataaatcccattctatcttttggtgttacaacaaatctttttttattttcagcataaatttctaatgcccgtggactagttataagttttgtcatctttggtacaggatcacaaattgtttcacatgtcataatattaatttctttatctttaccaacacggcgattaattatcaatgttctacgattaattgtatatttatatggtcgccataaagaaaaatatgcaataattaataatccacaaatagcacacactatcgcaggtaccatttgtccaattataaataaataaactacatataccatataaaagatttcaaagtatagtattgcgggattcaatttaattttaaactctttttctttcataataacctctctttttcctcaacttcatcattataacgtatcttaaatactataacaattataaattatcaatcattgataacttatagttactatattattaaataaagaaagacgggaaacccgtctttcgattatcaaacaagtttgttgaattattctgcagcttctgcagcttgtttgttttgatatctttcataagcaattaagaatggtacgtatactaagatagat

SEQ ID NO: 5 - DNA, 15 bp, Unknown
  Description of Unknown: DNA binding repeat
gtggtggtggtggtg

---

What is claimed is:

1. A pharmaceutical composition that reduces inflammation associated with Th17 differentiation in a subject in need thereof, that comprises a therapeutically effective amount of a single bacteria strain of the species *Erysipelatoclostridium ramosum*; and
  a pharmaceutically acceptable excipient, diluent, or carrier;
  wherein the therapeutically effective amount comprises from about $1\times10^3$ to about $1\times10^{11}$ CFU of the bacteria strain;
  wherein the bacterial strain is lyophilized; and
  wherein the bacteria strain comprises a polynucleotide sequence of a 16s rRNA gene that has at least 95% sequence identity to the polynucleotide sequence of SEQ ID NO:3, as determined by a Smith-Waterman homology search algorithm using an affine gap search with a gap open penalty of 12, a gap extension penalty of 2, and a Blocks Substitution Matrix (BLOSUM) of 62.

2. The pharmaceutical composition of claim 1, wherein the pharmaceutically acceptable excipient or carrier comprises a lyoprotectant.

3. The pharmaceutical composition of claim 1, wherein the bacteria strain comprises the polynucleotide sequence of SEQ ID NO:3.

4. The pharmaceutical composition of claim 1, wherein the pharmaceutical composition consists essentially of the bacteria strain of species *Erysipelatoclostridium ramosum*.

5. The pharmaceutical composition of claim 1, further comprising at least one additional bacteria strain.

6. The pharmaceutical composition of claim 1, wherein at least 50% of the bacteria strain as measured by an amount of colony forming units (CFU) remains viable after about 1 year of storage when the pharmaceutical composition is stored in a closed container at 25° C. at 95% relative humidity.

7. The pharmaceutical composition of claim 1, wherein the therapeutically effective amount comprises from about $1 \times 10^6$ to about $1 \times 10^{11}$ CFU/g of the bacteria strain with respect to a total weight of the pharmaceutical composition.

8. The pharmaceutical composition of claim 1, wherein the pharmaceutical composition is formulated for oral delivery, and wherein the pharmaceutical composition comprises an enteric coating.

9. The pharmaceutical composition of claim 1, wherein the pharmaceutical composition further comprises a prebiotic compound selected from the group consisting of: a fructo-oligosaccharide, a short-chain fructo-oligosaccharide, inulin, an isomalt-oligosaccharide, a transgalacto-oligosaccharide, a pectin, a xylo-oligosaccharide, a chitosan-oligosaccharide, a beta-glucan, an arable gum modified starch, a polydextrose, a D-tagatose, an acacia fiber, carob, an oat, and a citrus fiber.

10. The pharmaceutical composition of claim 1, wherein the pharmaceutical composition further comprises an adjuvant.

11. A method of treating a condition in a subject in need thereof, comprising administering to the subject a therapeutically effective amount of a pharmaceutical composition that comprises a bacteria strain of the species *Erysipelatoclostridium ramosum* and a pharmaceutically acceptable excipient, diluent, or carrier;
wherein the bacteria strain is present in an amount sufficient for treating a condition mediated by the Th17 pathway or by an increase in the IL-17 cytokine in the subject;
wherein the therapeutically effective amount comprises from about $1 \times 10^3$ to about $1 \times 10^{11}$ CFU of the bacteria strain;
wherein the bacteria strain is lyophilized; and
wherein the bacteria strain comprises a polynucleotide sequence of a 16s rRNA gene that has at least 95% identity to the polynucleotide sequence of SEQ ID NO:3, as determined by a Smith-Waterman homology search algorithm using an affine gap search with a gap open penalty of 12, a gap extension penalty of 2, and a Blocks Substitution Matrix (BLOSUM) of 62.

12. The method of claim 11, wherein the condition mediated by the Th17 pathway or by an increase in the IL-17 cytokine is uveitis, and wherein said treating or preventing comprises reducing or preventing retinal damage in uveitis.

13. The method of claim 11, wherein the bacteria strain is present in an amount sufficient for treating the condition mediated by the Th17 pathway, wherein the condition mediated by the Th17 pathway is a cancer, and wherein the cancer is breast cancer, lung cancer, liver cancer, colon cancer, or ovarian cancer.

14. The method of claim 11, wherein the bacteria strain comprises the polynucleotide sequence of SEQ ID NO:3.

15. The method of claim 11, wherein the subject has the condition, or has been identified as being at risk of the condition.

16. The method of claim 11, further comprising administering an additional therapeutic agent to the subject.

17. The method of claim 11, wherein the bacteria strain comprises a polynucleotide sequence of a 16s rRNA gene that has at least 99.5% sequence identity to the polynucleotide of SEQ ID NO:3, as determined by a Smith-Waterman homology search algorithm using an affine gap search with a gap open penalty of 12, a gap extension penalty of 2, and a BLOSUM of 62.

18. The method of claim 11, wherein the bacteria strain is the strain deposited under accession number NCIMB 42688.

19. The pharmaceutical composition of claim 1, wherein the bacteria strain is the strain deposited under accession number NCIMB 42688.

20. The pharmaceutical composition of claim 1, wherein the bacteria strain is strain JCM 1298.

21. The pharmaceutical composition of claim 1, wherein the bacteria has a fermentation profile of a bacteria strain selected from the group consisting of ATCC 25582, JCM 1298, and MRX027.

22. The pharmaceutical composition of claim 1, wherein the bacteria has a fermentation profile of a bacteria strain deposited under accession number NCIMB 42689.

23. The pharmaceutical composition of claim 1, wherein the bacteria strain is not in sporulated form or comprises spores in a de minimis amount.

* * * * *